(12) United States Patent
Duchateau et al.

(10) Patent No.: US 11,903,968 B2
(45) Date of Patent: Feb. 20, 2024

(54) ENGINEERED IMMUNE CELLS RESISTANT TO TUMOR MICROENVIRONMENT

(71) Applicant: CELLECTIS, Paris (FR)

(72) Inventors: Philippe Duchateau, Draveil (FR); Anne-Sophie Gautron, Etrechy (FR); Laurent Poirot, Paris (FR); Julien Valton, New York, NY (US)

(73) Assignee: CELLECTIS, Paris (FR)

( * ) Notice: Subject to any disclaimer, the term of this patent is extended or adjusted under 35 U.S.C. 154(b) by 538 days.

(21) Appl. No.: 16/629,506

(22) PCT Filed: Jul. 20, 2018

(86) PCT No.: PCT/EP2018/069734
§ 371 (c)(1),
(2) Date: Jan. 8, 2020

(87) PCT Pub. No.: WO2019/016360
PCT Pub. Date: Jan. 24, 2019

(65) Prior Publication Data
US 2021/0128613 A1  May 6, 2021

Related U.S. Application Data

(60) Provisional application No. 62/535,448, filed on Jul. 21, 2017.

(30) Foreign Application Priority Data

Aug. 7, 2017 (DK) .............................. PA201770603

(51) Int. Cl.
| | |
|---|---|
| *C12N 5/00* | (2006.01) |
| *A61K 35/17* | (2015.01) |
| *A61K 39/395* | (2006.01) |
| *C07K 16/28* | (2006.01) |
| *C12N 5/0783* | (2010.01) |
| *C12N 15/113* | (2010.01) |

(52) U.S. Cl.
CPC ........ *A61K 35/17* (2013.01); *A61K 39/39541* (2013.01); *C07K 16/2818* (2013.01); *C12N 5/0636* (2013.01); *C12N 15/113* (2013.01); *C12N 2310/14* (2013.01); *C12N 2510/00* (2013.01)

(58) Field of Classification Search
CPC .............. A61K 35/17; A61K 39/39541; C07K 16/2818; C12N 5/0636; C12N 15/113; C12N 2310/14; C12N 2510/00
See application file for complete search history.

(56) References Cited

U.S. PATENT DOCUMENTS

2016/0120906 A1* 5/2016 Galetto ................ C12N 5/0636
435/375

FOREIGN PATENT DOCUMENTS

| WO | 2013176915 A1 | 11/2013 |
|---|---|---|
| WO | 2014184741 A1 | 11/2014 |
| WO | 2016019300 A1 | 2/2016 |
| WO | 2017001572 A1 | 1/2017 |
| WO | WO2017001572 | * 1/2017 |
| WO | 2017017184 A1 | 2/2017 |
| WO | 2017079622 A1 | 5/2017 |
| WO | 2017114497 A1 | 7/2017 |
| WO | 2018073393 A1 | 4/2018 |

OTHER PUBLICATIONS

Hegde et al (Cancer Immunol Immunother 66:1113-1121, 2017 (Year: 2017).*
Corvazier et al (Biochemica et biophysica Acta 1788:587-599, 2009 (Year: 2009).*
Sandelain et al., Cancer Discov 2013, 3: 388-398 (Year: 2013).*
Casemore et al., Integr Cancer Sci Therapy 2015, 2:100-103 (Year: 2015).*
Pearce et al., Science 2013, 342, 1242454 (Year: 2013).*
Ganapathy-Kanniappan., Molecular Cancer 2013, 12:152 (Year: 2013).*
European Patent Office, International Search Report, Appln. PCT/EP2018/069734, dated Dec. 20, 2018.
Hegde et al: "Current status of chimeric antigen receptor engineered T cell-based and immune checkpoint blockade-based cancer immunotherapies", Cancer Immunology, Immunotherapy, vol. 66, No. 9, May 11, 2017 (May 11, 2017), pp. 1113-1121.
Rupp et al: "CRISPR/Cas9-mediated PD-1 disruption enhances anti-tumor efficacy of human chimeric antigen receptor T cells", Scientific Reports, vol. 7, No. 1, Apr. 7, 2017 (Apr. 7, 2017).
Beatty et al: "Chimeric antigen receptor T cells are vulnerable to immunosuppressive mechanisms present within the tumor microenvironment", ONCOIMMUNOLOGY, vol. 3, No. 11, Nov. 2, 2014 (Nov. 2, 2014), p. e970027.
Zhu et al: "An IL-27/NFIL3 signalling axis drives Tim-3 and IL-10 expression and T-cell dysfunction", Nature Communications, vol. 6, Jan. 23, 2015 (Jan. 23, 2015), p. 6072.
Wu et al: "Rescuing lymphocytes from HLA-G immunosuppressive effects mediated by the tumor microenvironment", ONCOTARGET, vol. 6, No. 35, Nov. 10, 2015 (Nov. 10, 2015).
Loumagne et al: "In vivo evidence that secretion of HLA-G by immunogenic tumor cells allows their evasion from immunosurveillance : Soluble HLA-G Mediates Tumor Escape In Vivo", International Journal of Cancer, vol. 135, No. 9, Nov. 1, 2014 (Nov. 1, 2014), pp. 2107-2117.
Kailayangiri et al: "Targeting Ewing sarcoma with activated andGD2-specific chimeric antigen receptor-engineered human NK cells induces upregulation of immune-inhibitory HLA-G", Oncoimmunology, vol. 6, No. 1, Jan. 2, 2017 (Jan. 2, 2017), p. e1250050.

(Continued)

*Primary Examiner* — Lei Yao
(74) *Attorney, Agent, or Firm* — Arrigo, Lee, Guttman & Mouta-Bellum LLP

(57) ABSTRACT

The invention pertains to the field of adoptive cell immunotherapy. It provides with engineered immune cells comprising genetic alteration into genes which are involved into immune functions downregulation, especially in response to environment signals such as nutrients depletion. Such method allows the production of more potent immune cells in the context of tumors' microenvironment.

9 Claims, 1 Drawing Sheet
Specification includes a Sequence Listing.

(56) References Cited

OTHER PUBLICATIONS

Rajagopalan et al: "Aptamer-Targeted Attenuation of IL-2 Signaling in CD8 + T Cells Enhances Antitumor Immunity", Molecular Therapy : The Journal of the American Society of Gene Therapy, vol. 25, No. 1, Jan. 1, 2017 (Jan. 1, 2017), pp. 54-61.

Carissimi et al: "miR-21 is a negative modulator of T-cell activation", Biochimie, Masson, Paris, FR, vol. 107, Oct. 7, 2014 (Oct. 7, 2014), pp. 319-326.

Mima et al: "MicroRNA MIR21 and T Cells in Colorectal Cancer", Cancer Immunology Research, vol. 4, No. 1, Sep. 29, 2015 (Sep. 29, 2015), pp. 33-40.

Smigielska-Czepiel et al: "Dual Role of miR-21 in CD4+ T-Cells: Activation-Induced miR-21 Supports Survival of Memory T-Cells and Regulates CCR7 Expression in Naive T-Cells", PLOS ONE, vol. 8, No. 10, Jan. 1, 2013 (Jan. 1, 2013), pp. e76217.

Ji et al: "Enhancing adoptive T cell immunotherapy with microRNA therapeutics", Seminars in Immunology, vol. 28, No. 1, Dec. 20, 2015 (Dec. 20, 2015), pp. 45-53.

Iamsawat et al: "Stabilization of Foxp3 by Targeting JAK2 Enhances Efficacy of CD8 Induced Regulatory T Cells In the Prevention of Graft-versus-Host Disease", The Journal of Immunology, vol. 201, No. 9, Sep. 21, 2018 (Sep. 21, 2018), pp. 2812-2823.

He et al: "A Jak2-selective inhibitor potently reverses the immune suppression by modulating the tumor microenvironment for cancer immunotherapy", Biochemical Pharmacology, vol. 145, Aug. 30, 2017 (Aug. 30, 2017), pp. 132-146.

Betts et al: "Targeting Aurora kinase A and JAK2 prevents GVHD while maintaining T reg and antitumor CTL function", Science Translational Medicine, vol. 9, No. 372, Jan. 11, 2017 (Jan. 11, 2017), p. eaai8269.

* cited by examiner

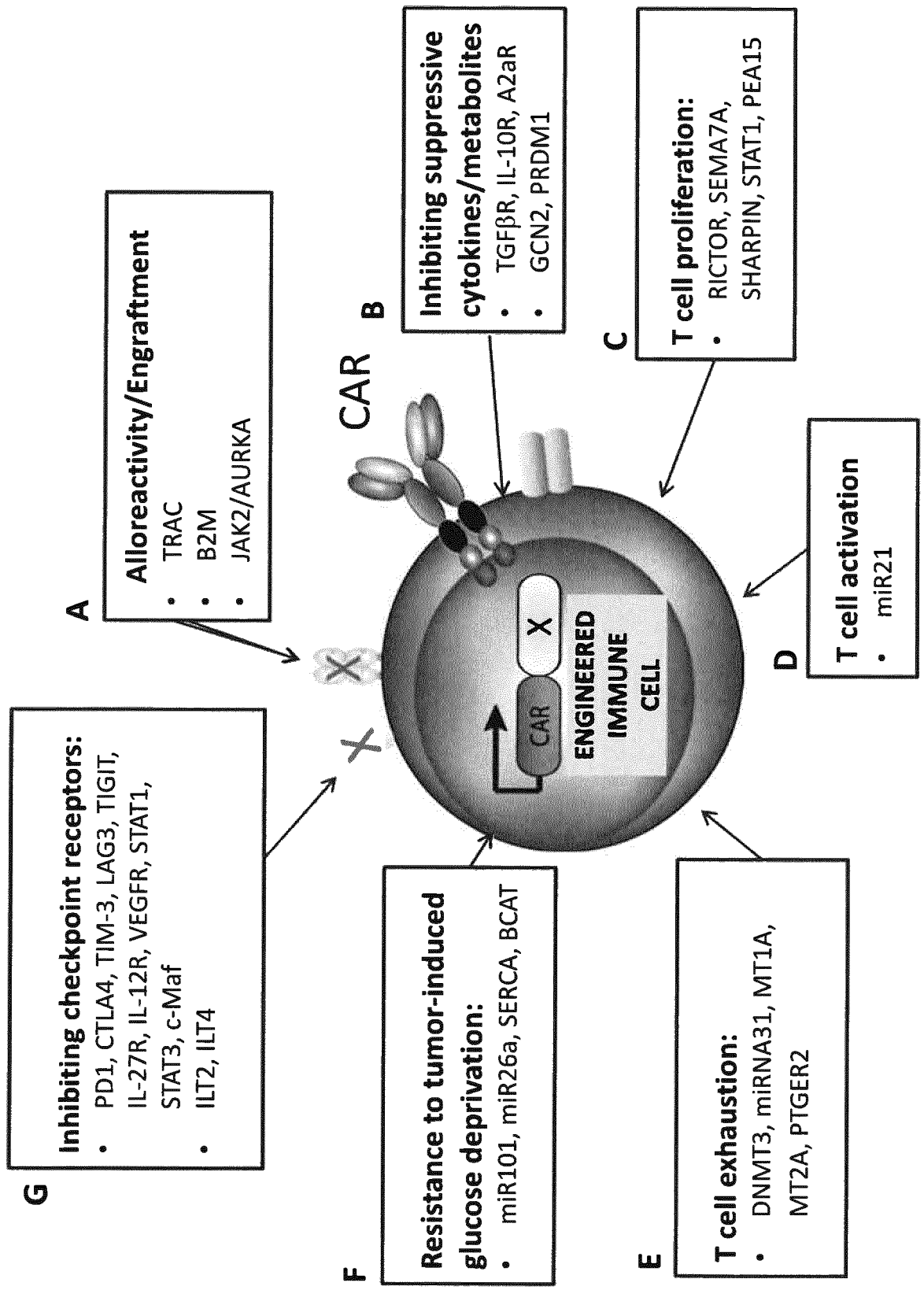

ENGINEERED IMMUNE CELLS RESISTANT TO TUMOR MICROENVIRONMENT

CROSS REFERENCE TO RELATED APPLICATIONS

This application is a U.S. National Stage Application of PCT Application No. PCT/EP2018/069734 under 37 C.F.R. § 371, with an international filing date of Jul. 20, 2018, which claims the benefit of U.S. provisional application 62/535,448, filed Jul. 21, 2017 and claims priority to Danish Patent Application No. PA201770603 filed Aug. 7, 2017, all of which are herein incorporated by reference in their entirety.

FIELD OF THE INVENTION

The invention pertains to the field of adoptive cell immunotherapy. It provides with engineered immune cells comprising genetic alterations into genes which are involved into immune functions downregulation, especially in response to environment signals such as nutrients depletion or cytokines. Such method allows the production of more potent immune cells, which are especially resistant to adverse tumors' microenvironment.

BACKGROUND OF THE INVENTION

Adoptive immunotherapy, which involves the transfer of autologous antigen-specific T-cells generated ex vivo, is a promising strategy to treat cancer. The T-cells used for adoptive immunotherapy can be generated either by expansion of antigen-specific T-cells or redirection of T-cells through genetic engineering [Park, Rosenberg et al. (2011) Treating cancer with genetically engineered T cells. *Trends in Biotechnology* 29(11): 550-557]. Isolation and transfer of tumor specific T-cells has been shown to be successful in treating melanoma. Novel specificities in T-cells have been successfully generated through the genetic transfer of transgenic T cell receptors or chimeric antigen receptors (CARs).

CARs are synthetic receptors consisting of a targeting moiety that is associated with one or more signaling domains in a single fusion molecule. CARs have successfully allowed T-cells to be redirected against antigens expressed at the surface of tumor cells from various malignancies including lymphomas and solid tumors [Jena, Dotti et al. (2010) Redirecting T-cell specificity by introducing a tumor-specific chimeric antigen receptor. *Blood.* 116:1035-1044].

Recombinant T cell receptors are artificial polypeptide constructs consisting preferably of a single amino acid strand, which like native heterodimeric TCRs bind to MHC-peptide complexes. Recombinant TCRs are preferably single-chain polypeptides, such as described by Stone J. D, et al. [A novel T cell receptor single-chain signaling complex mediates antigen-specific T cell activity and tumor control (2014) *Cancer Immunol. Immunother.* 63(11):1163-76].

However, even when a CAR-T cell infiltrates a tumor, it is subjected to a variety of immunosuppressive and regulatory signals in the microenvironment that causes T cell dysfunction or exhaustion. The tumor microenvironment is composed of numerous cells, in addition to cancer cells, that has been recruited and can be immunosuppressive such as myeloid-derived suppressor cells (MDSCs) and regulatory T-cells. Such cells along with cancer cells tolerate tolerogenic signals, such as interleukin-10 (IL-10), transforming growth factor beta (TGF-b) and extracellular adenosine. T-cells get dysfunctional due to diverse deficits in effector functions, including impaired proliferative capacity, cytotoxicity, and production of pro-inflammatory cytokines [Pardoll, D. M. (2012) The blockade of immune checkpoints in cancer immunotherapy. *Nature Reviews Cancer* 12:252-264][Wherry and Kurachi, (2015) Molecular and cellular insights into T cell exhaustion. *Nature Reviews Immunology* 15:486-499]. Consequently, the cancer cells can escape immune elimination by multiple mechanisms by which tumors circumvent tumor immune-surveillance. One of these mechanisms consists of the activation of inhibitory receptors. Exhausted and/or dysfunctional T-cells have been noted to express high levels of co-inhibitory receptors, such as PD-1 and CTLA-4, and blockade of these receptors has been associated with the recovery of effector T cell responses in experimental models of cancer [Leach, D. R., et al. (1996) nhancement of Antitumor Immunity by CTLA-4 Blockade. *Science.* 271:1734-1736][Barber, D. L. et al. (2006) Restoring function in exhausted CD8 T cells during chronic viral infection. *Nature* 439:682-687][Mahoney et al., (2015) Combination cancer immunotherapy and new immunomodulatory targets. *Nature Reviews Drug Discovery.* 14:561-584]. In addition, therapeutic blockade of CTLA-4 and PD-1 has been successfully translated to the clinic for the treatment several human cancers [Hamid, O. et al, (2013) Safety and Tumor Responses with Lambrolizumab (Anti-PD-1) in Melanoma. *The New England Journal of Medicine* 369:134-144]. T-cells express multiple co-inhibitory receptors in addition to CTLA-4 and PD-1, such as T-cell immunoglobulin and mucin-domain containing-3 (Tim-3), Lymphocyte-activation gene 3 (Lag-3), and T cell immunoreceptor with Ig and ITIM domains (TIGIT); (Anderson et al. (2016) ag-3, Tim-3, and TIGIT: Co-inhibitory Receptors with Specialized Functions in Immune Regulation. *Immunity.* 44:989-1004]. Co-inhibitory receptor co-expression is directly correlated to the severity of dysfunctional phenotype [Wherry and Kurachi, (2015) Molecular and cellular insights into T cell exhaustion. *Nature Reviews Immunology* 15:486-499].

Combination therapies that simultaneously target multiple co-inhibitory pathways, such as CTLA-4 together with PD-1, or PD-1 together with TIM-3, LAG-3, or TIGIT, are more potent at restoring antitumor immunity than blockade of single co-inhibitory targets in both humans and in experimental mouse tumor models [Fourcade, J. et al. (2014) PPD-1 and Tim-3 regulate the expansion of tumor antigen-specific CD8+ T cells induced by melanoma vaccines. *Cancer research.* 74:1045-1055]. Thus, inhibition of several inhibitory receptors in combination with downregulation of tolerogenic signal may be of a great value to improve adoptive T cell therapy.

In previous applications (WO2013176915, WO2014184741 and WO2014184744), the applicant has established that sequence specific reagents, in particular rare-cutting endonucleases, can be used to produce genetically engineered primary immune cells of clinical grade with improved therapeutic potency and resistance to lymphodepleting agents. However, the genes primarily targeted along these first developments were in direct relation with the expression of co-inhibitory receptors.

In order to move beyond these lines, and finally be able to combine cell therapy with the previous immunotherapy approaches, the present inventors have started to work on alternative genes, which could be new candidates for genome engineering in primary cells, while being compatible with the expression of CARs and recombinant T-cell receptors. To this aim, they made a number of hypothesis and experiments regarding different regulation pathways, and identified promising target genes which could be activated and inactivated in conjunction with the activation of effector immune cells, conferring such cells "genetic attributes" that leverage their therapeutic potency.

The inventors have more particularly investigated the ability of tumors cells to create an immunosuppressive environment due to its their metabolisms creating a lack of crucial carbon sources and intermediates that are needed for T-cell function. For example, cancer cells utilize aerobic glycolysis for energy production. As a result, the tumor microenvironment has low glucose, low oxygen and low pH. Upon activation or antigen recognition T cells are shifting part of their energy production metabolism towards aerobic glycolysis that is essential for production of effector molecules such as IFNg, IL-2 IL-17 and Granzyme B (Pearce et al. (2013) Fueling Immunity: Insights into Metabolism and Lymphocyte Function. *Science*. 342 (6155):1242454).

Following this approach, the inventors have identified several genes, the inactivation of which improves immune functions of allogeneic CAR T-cells, especially, in relation with the microenvironment of tumors.

The present application thus discloses new genetic attributes conferring immune cells improved therapeutic potencies, especially in conjunction with the expression of CARs and Recombinant T-cell receptors.

The genome engineering of the immune cells, as per the present invention, tend to reinforce the therapeutic potential of primary immune cells in general, in particular by increasing their life span, persistence and immune activity, as well as by limiting cell exhaustion. The invention may be carried out on primary cells originating from patients as part of autologous treatment strategies, as well as from donors, as part of allogeneic treatment strategies, but also on immune cells derived from stem cells, induced pluripotent stem cells or from progenitor cells.

SUMMARY OF THE INVENTION

As part of their most successful investigations, the inventors have introduced genetic alterations in hematopoietic cells aiming at reducing or inactivating the expression of a selection of genes negatively regulating lymphocyte activation, especially in relation with tumor environment signals, to produce engineered immune cells in which the expression of one or several of the following polynucleotide sequences is modified:
  a) polynucleotide sequence(s), which expression is(are) involved into reduction of glycolysis and calcium signaling in response to a low glucose condition, such as SERCA3 to increase calcium signaling, miR101 and mir26A to increase glycolysis, BCAT1 to mobilize glycolytic reserves; and/or
  b) polynucleotide sequence(s), which expression up regulate(s) immune checkpoint proteins (e.g. TIM3, CEACAM, LAG3, TIGIT), such as IL27RA, STAT1, STAT3; and/or
  c) polynucleotide sequence(s), which expression mediate(s) interaction with HLA-G, such as ILT2 or ILT4; and/or
  d) polynucleotide sequence(s), which expression is(are) involved into the down regulation of T-cell proliferation such as SEMA7A, SHARPIN to reduce Treg proliferation, STAT1 to lower apoptosis, PEA15 to increase IL-2 secretion and RICTOR to favor CD8 memory differentiation; and/or
  e) polynucleotide sequence(s), which expression is(are) involved into the down regulation of T-cell activation, such as mir21; and/or
  f) polynucleotide sequence(s), which expression is(are) involved in signaling pathways responding to cytokines, such as JAK2 and AURKA; and/or
  g) polynucleotide sequence(s), which expression is(are) involved in T-cell exhaustion, such as DNMT3, miRNA31, MT1A, MT2A, PTGER2.

More particularly, the invention relates to engineered immune cells that have been genetically modified to reduce or inactivate the expression of their microRNA genomic sequences, such as mir21, mir26A or mir101.

The cells according to the invention are engineered more particularly in view of expressing a chimeric antigen receptor (CAR) or a component of a recombinant T-cell receptor to perform immunotherapy. They can also comprise combinations of gene editing events to improve their therapeutic efficacy with respect to certain therapeutic indications or in regard of certain types of tumors. Cells with various genotypes can be produced by the methods of the present invention as further detailed herein.

The invention encompasses the therapeutic use of these cells, as well as the compositions and populations comprising said cells to be used as medicaments.

The present invention can be further summarized by the following items:

1) An engineered immune cell expressing a chimeric antigen receptor (CAR) or a component of a recombinant T-cell receptor; wherein said cell has been genetically modified to reduce or inactivate the expression of at least one endogenous polynucleotide sequence selected from:
  a) polynucleotide sequence(s), which expression is(are) involved into reduction of glycolysis and calcium signaling in response to a low glucose condition, such as SERCA3 to increase calcium signaling, miR101 and mir26A to increase glycolysis, BCAT to mobilize glycolytic reserves; and/or
  b) polynucleotide sequence(s), which expression up regulate(s) immune checkpoint proteins (e.g. TIM3, CEACAM, LAG3, TIGIT), such as IL27RA, STAT1, STAT3; and/or
  c) polynucleotide sequence(s), which expression mediate(s) interaction with HLA-G, such as ILT2 or ILT4; and/or
  d) polynucleotide sequence(s), which expression is(are) involved into the down regulation of T-cell proliferation such as SEMA7A, SHARPIN to reduce Treg proliferation, STAT1 to lower apoptosis, PEA15 to increase IL-2 secretion and RICTOR to favor CD8 memory differentiation; and/or
  e) polynucleotide sequence(s), which expression is(are) involved into the down regulation of T-cell activation, such as mir21; and/or
  f) polynucleotide sequence(s), which expression is(are) involved in signaling pathways responding to cytokines, such as JAK2 and AURKA; and/or
  g) polynucleotide sequence(s), which expression is(are) involved in T-cell exhaustion, such as DNMT3, miRNA31, MT1A, MT2A, PTGER2.
2) An engineered immune cell expressing a chimeric antigen receptor (CAR) or a component of a recombinant T-cell receptor; wherein said cell has been genetically modified to reduce or inactivate the expression of microRNA genomic sequences.

3) An engineered immune cell according to item 2, where said microRNA genomic sequences are selected from miR21, mir26A and miR101.
4) An engineered immune cell according to any one of items 1 to 3, wherein said endogenous polynucleotide sequence has been inactivated by means of a rare-cutting endonuclease, such as TALEN, RNA-guided endonuclease, ZFN, meganuclease, megaTAL.
5) An engineered immune cell according to any one of items 1 to 3, wherein the expression of said endogenous polynucleotide sequence has been reduced or inactivated by means of RNAi.
6) An engineered immune cell according to any one of items 1 to 5, wherein said cell is further engineered to reduce or inactivate the expression of one endogenous TCR, β2m or HLA component.
7) An engineered immune cell according to any one of items 1 to 6, wherein said cell is a primary immune cell originating from a patient, a donor, or differentiated from stem cells.
8) An engineered immune cell according to any one of items 1 to 7, wherein said endogenous polynucleotide coding sequence is inactivated by the insertion of the exogenous polynucleotide sequences expressing the CAR or component of recombinant TCR.
9) A therapeutically effective population of cells, comprising at least 30%, preferably 50%, more preferably 80% of cells according to any one of items 1 to 8.
10) A population of of cells according to item 9, wherein at least 30%, preferably 50%, more preferably 80% of cells originate from a donor or stem cell lineage, preferably one single donor or stem cell lineage.
11) A population of primary immune cells according to any one of items 9 or 10, wherein at least more than 50% of said immune cells are CAR or recombinant TCR positive cells.
12) An engineered immune cell or population of cells according to any one of items 1 to 11, for its use in immunotherapy.
13) An engineered immune cell according to item 12, for its use for treating cancer.
14) An engineered immune cell or population of cells according to any one of items 1 to 11, for its use in immunotherapy in combination with immune checkpoint inhibitors, such as a PD1 or CTLA4 antibody.
15) A pharmaceutical composition comprising an engineered immune cell or immune cell population according to any one of items 1 to 14.
16) A method for preparing engineered immune cells for cell immunotherapy, said method comprising:
providing a population of immune cells;
introducing subsequently or simultaneously, into a proportion of said primary immune cells:
i) At least one nucleic acid comprising an exogenous polynucleotide sequence to express a chimeric antigen receptor or a component of a recombinant TCR;
ii) At least one sequence-specific reagent that specifically targets an endogenous coding sequence selected from:
a) polynucleotide sequence(s), which expression is(are) involved into reduction of glycolysis and calcium signaling in response to a low glucose condition, such as SERCA3 to increase calcium signaling, miR101 and mir26A to increase glycolysis, BCAT to mobilize glycolytic reserves; and/or
b) polynucleotide sequence(s), which expression up regulate(s) immune checkpoint proteins (e.g. TIM3, CEACAM, LAG3, TIGIT), such as IL27RA, STAT1, STAT3; and/or
c) polynucleotide sequence(s), which expression mediate(s) interaction with HLA-G, such as ILT2 or ILT4; and/or
d) polynucleotide sequence(s), which expression is(are) involved into the down regulation of T-cell proliferation such as SEMA7A, SHARPIN to reduce Treg proliferation, STAT1 to lower apoptosis, PEA15 to increase IL-2 secretion and RICTOR to favor CD8 memory differentiation; and/or
e) polynucleotide sequence(s), which expression is(are) involved into the down regulation of T-cell activation, such as mir21; and/or
f) polynucleotide sequence(s), which expression is(are) involved in signaling pathways responding to cytokines, such as JAK2 and AURKA; and/or
g) polynucleotide sequence(s), which expression is(are) involved in T-cell exhaustion, such as DNMT3, miRNA31, MT1A, MT2A, PTGER2;
iii) Expanding and purifying said cells optionally under stringent condition(s) to select engineered cells.
17) Method according to item 16, wherein said sequence specific reagent is a specific rare cutting endonuclease.
18) Method according to any one of items 16 or 17, wherein said rare-cutting endonuclease reagent is selected from a RNA or DNA-guided endonuclease, such as Cas9 or Cpf1, a RNA or DNA guide, a TAL-endonuclease, a zing finger nuclease, a homing endonuclease or any combination thereof.
19) Method according to any one of items 16 to 18, wherein said specific endonuclease reagent is introduced by electroporation as a polypeptide or under a mRNA, which is translated into the cell.
20) Method according to any one of items 16 to 19, wherein said exogenous nucleic acid comprising said coding sequence is included in a DNA vector.
21) Method according to item 20, wherein said DNA vector is a viral vector such as an AAV vector.
22) Method according to any one of items 16 to 21, wherein the expression of DCK, HPRT or GGH is also reduced or inactivated in said immune cells to confer resistance to drugs.
23) Method according to any one of items 16 to 22, wherein the expression of a receptor to immune depletion treatments, such a Glucocorticoid receptor and CD52, is further reduced or inactivated.
24) Method according to any one of items 16 to 23, wherein said immune cell is a primary T-cell or NK cell, or a precursor thereof.
25) An engineered primary immune cell or population of cells obtainable by the method of any one of items 16 to 24.

Generally, a "reduced or inactivated expression" of a polynucleotide sequence, such as a gene, or microRNA genomic sequence of interest (and as disclosed herein) can be determined by comparing the level of expression of the polynucleotide sequence or microRNA genomic sequence of interest within the genetically modified cell with that of an otherwise identical cell that does not carry said genetic modification (control cell). The control cell may be a mock transfected cell, which means that the control cell has been transfected with non-coding mRNA.

BRIEF DESCRIPTION OF THE FIGURES AND TABLES

FIG. 1: Schematic representation of the diversity of immune cells that can be engineered according to the invention. The panels correspond to the main functions, which can be boosted or reduced by genetic alteration. The invention encompasses any alteration of the expression of one or several genes from the different panels, alone or in combination.

A—Alloreactivity/Engraftment: weakening self and non-self-recognition mechanisms in order to produce engineered allogeneic cells that are less alloreactive.

B—Inhibiting suppressive cytokines/metabolites: reducing the production by the immune cells of cytokines and metabolites, the secretion of which have a negative influence on immune cells activation.

C—T-cell proliferation: inhibiting genetic pathways that down regulate T-cell proliferation.

D—T-cell activation: inhibiting genetic pathways that down regulate T-cell activation.

E—T-cell exhaustion: inhibiting genetic pathways that trigger T-cell exhaustion.

F—Resistance to tumor-induced glucose deprivation: inhibiting genetic pathways that down regulate T-cells proliferation and activation in response to glucose deprived microenvironment.

G—Immune checkpoint receptors: reducing control of immune checkpoints on the activation of the engineered immune cells by inhibiting their receptors and pathways controlled by these receptors.

Optionally, the engineered immune cell may be endowed with a chimeric antigen receptor (CAR), which is preferably integrated at a locus X (X=any of the gene expressing the proteins referred to in panels A to G).

Table 1: Preferred target genes for the production of engineered immune cells with enhanced immune functions according to the present invention. This table lists the phenotype/genotypes of preferred engineered immune cells obtainable through the teaching of the present invention.

$[X]^{neg}$ means that expression of X is voluntarily reduced or suppressed as per the present invention.

Table 2: polynucleotide genomic sequences targeted by the sequence specific endonuclease reagents used in the examples.

Table 3: Polypeptide sequences of TALEN® reagents used in the examples.

TABLE 1

Preferred target genes for the production of engineered immune cells with enhanced immune functions according to the present invention:

| Primary target genes | | Genotype of preferred engineered Immune cells | | | | |
|---|---|---|---|---|---|---|
| | | Additional KO to lower alloreactivity: [TCR]$^{neg}$ [β2m]$^{neg}$ [HLA]$^{neg}$ | Additional KO to inactivate checkpoint inhibitors: [PD1]$^{neg}$ [CTLA4]$^{neg}$ [TIM-3]$^{neg}$ [LAG3]$^{neg}$ [TIGIT]$^{neg}$ | | Additional KO to confer resistance to drugs: Purine analogue drugs: [DCK]$^{neg}$ 6 mercaptopurine (6 MP) and 6 thioguanine (6 TG): [HPRT]$^{neg}$ | Resistance to immunodepletion agents: glucocorticoids receptors: [GR]$^{neg}$ Alemtuzumab receptor [CD52]$^{neg}$ |
| Single KO | Phenotype | | | | | |
| [BCAT1]$^{neg}$ Aliases: [BCAT]$^{neg}$ [BCT1]$^{neg}$ [BCATC]$^{neg}$ [ECA39]$^{neg}$ [MECA39]$^{neg}$ [PNAS121]$^{neg}$ [PP18]$^{neg}$ | Increased glycolysis | [BCAT1]$^{neg}$ [TCR]$^{neg}$ [BCAT1]$^{neg}$ [β2m]$^{neg}$ [BCAT1]$^{neg}$ [HLA]$^{neg}$ [BCAT1]$^{neg}$ [TCR]$^{neg}$ [β2m]$^{neg}$ [BCAT1]$^{neg}$ [TCR]$^{neg}$ [HLA]$^{neg}$ | [BCAT1]$^{neg}$ [TCR]neg[PD1]$^{neg}$ [BCAT1]$^{neg}$ [TCR]$^{neg}$[CTLA4]$^{neg}$ [BCAT1]$^{neg}$ [TCR]$^{neg}$[TIM-3]$^{neg}$ [BCAT1]$^{neg}$ [TCR]$^{neg}$[LAG3]$^{neg}$ [BCAT1]$^{neg}$ [TCR]$^{neg}$[TIGIT]$^{neg}$ [BCAT1]$^{neg}$ [β2m]$^{neg}$[PD1]$^{neg}$ [BCAT1]$^{neg}$ [β2m]$^{neg}$[CTLA4]$^{neg}$ [BCAT1]$^{neg}$ [β2m]$^{neg}$ [TIM-3]$^{neg}$ [BCAT1]$^{neg}$ [β2m]$^{neg}$ [LAG3]$^{neg}$ [BCAT1]$^{neg}$ [β2m]$^{neg}$ [TIGIT]$^{neg}$ [BCAT1]$^{neg}$ [HLA]$^{neg}$ [PD1]$^{neg}$ [BCAT1]$^{neg}$ [HLA]$^{neg}$[CTLA4]$^{neg}$ [BCAT1]$^{neg}$ [HLA]neg[TIM-3]$^{neg}$ [BCAT1]$^{neg}$ [HLA]neg[LAG3]$^{neg}$ [BCAT1]$^{neg}$ | | [BCAT1]$^{neg}$ [TCR]$^{neg}$[DCK]$^{neg}$ [BCAT1]$^{neg}$ [TCR]$^{neg}$[HPRT]$^{neg}$ [BCAT1]$^{neg}$ [β2m]$^{neg}$[DCK]$^{neg}$ [BCAT1]$^{neg}$ [β2m]$^{neg}$[HPRT]$^{neg}$ [BCAT1]$^{neg}$ [HLA]$^{neg}$[DCK]$^{neg}$ [BCAT1]$^{neg}$ [HLA]$^{neg}$[HPRT]$^{neg}$ [BCAT1]$^{neg}$ [DCK]$^{neg}$[PD1]$^{neg}$ [BCAT1]$^{neg}$ [DCK]$^{neg}$[CTLA4]$^{neg}$ [BCAT1]$^{neg}$ [DCK]$^{neg}$[TIM-3]$^{neg}$ [BCAT1]$^{neg}$ [DCK]$^{neg}$[LAG3]$^{neg}$ [BCAT1]$^{neg}$ [DCK]$^{neg}$[TIGIT]$^{neg}$ [BCAT1]$^{neg}$ [HPRT]$^{neg}$[PD1]$^{neg}$ [BCAT1]$^{neg}$ [HPRT]$^{neg}$[CTLA4]$^{neg}$ [BCAT1]$^{neg}$ [HPRT]$^{neg}$[TIM-3]$^{neg}$ [BCAT1]$^{neg}$ [HPRT]$^{neg}$[LAG3]$^{neg}$ [BCAT1]$^{neg}$ [HPRT]$^{neg}$[TIGIT]$^{neg}$ | [BCAT1]$^{neg}$ [TCR]$^{neg}$[GR]$^{neg}$ [BCAT1]$^{neg}$ [TCR]$^{neg}$[CD52]$^{neg}$ [BCAT1]$^{neg}$ [β2m]$^{neg}$[GR]$^{neg}$ [BCAT1]$^{neg}$ [β2m]$^{neg}$[CD52]$^{neg}$ [BCAT1]$^{neg}$ [HLA]$^{neg}$[GR]$^{neg}$ [BCAT1]$^{neg}$ [HLA]$^{neg}$[CD52]$^{neg}$ [BCAT1]$^{neg}$ [GR]$^{neg}$[PD1]$^{neg}$ [BCAT1]$^{neg}$ [GR]$^{neg}$[CTLA4]$^{neg}$ [BCAT1]$^{neg}$ [GR]$^{neg}$[TIM-3]$^{neg}$ [BCAT1]$^{neg}$ [GR]$^{neg}$[LAG3]$^{neg}$ [BCAT1]$^{neg}$ [GR]$^{neg}$[TIGIT]$^{neg}$ [BCAT1]$^{neg}$ [CD52]$^{neg}$[PD1]$^{neg}$ [CD52]$^{neg}$[CTLA4]$^{neg}$ [BCAT1]$^{neg}$ [CD52]$^{neg}$[TIM-3]$^{neg}$ [BCAT1]$^{neg}$ [CD52]$^{neg}$[LAG3]$^{neg}$ [BCAT1]$^{neg}$ [CD52]$^{neg}$[TIGIT]$^{neg}$ |
| [SERCA]$^{neg}$ Aliases: [ATP2A3]$^{neg}$ [SERCA3]$^{neg}$ | Increased glycolysis | [SERCA]$^{neg}$ [TCR]$^{neg}$ [SERCA]$^{neg}$ [β2m]$^{neg}$ [SERCA]$^{neg}$[HLA]$^{neg}$ [SERCA]$^{neg}$ [TCR]$^{neg}$ [β2m]$^{neg}$ [SERCA]$^{neg}$ [TCR]$^{neg}$ [HLA]$^{neg}$ | [SERCA]$^{neg}$ [TCR]$^{neg}$ [PD1]$^{neg}$ [SERCA]$^{neg}$ [TCR]$^{neg}$[CTLA4]$^{neg}$ [SERCA]$^{neg}$ [TCR]$^{neg}$[TIM-3]$^{neg}$ [SERCA]$^{neg}$ [TCR]$^{neg}$[LAG3]$^{neg}$ [SERCA]$^{neg}$ [TCR]$^{neg}$[TIGIT]$^{neg}$ [SERCA]$^{neg}$ [β2m]$^{neg}$[PD1]$^{neg}$ [β2m]$^{neg}$[CTLA4]$^{neg}$ [SERCA]$^{neg}$ [β2m]$^{neg}$ [TIM-3]$^{neg}$ [SERCA]$^{neg}$ [β2m]$^{neg}$ [LAG3]$^{neg}$ [SERCA]$^{neg}$ [β2m]$^{neg}$ [TIGIT]$^{neg}$ [SERCA]$^{neg}$ [HLA]$^{neg}$ [PD1]$^{neg}$ [HLA]$^{neg}$[CTLA4]$^{neg}$ [SERCA]$^{neg}$ [HLA]$^{neg}$[TIM-3]$^{neg}$ [SERCA]$^{neg}$ [HLA]$^{neg}$[LAG3]$^{neg}$ [SERCA]$^{neg}$ [HLA]$^{neg}$[TIGIT]$^{neg}$ | | [SERCA]$^{neg}$ [TCR]$^{neg}$[DCK]$^{neg}$ [SERCA]$^{neg}$ [TCR]$^{neg}$[HPRT]$^{neg}$ [SERCA]$^{neg}$ [β2m]$^{neg}$[DCK]$^{neg}$ [SERCA]$^{neg}$ [β2m]$^{neg}$[HPRT]$^{neg}$ [SERCA]$^{neg}$ [HLA]$^{neg}$[DCK]$^{neg}$ [SERCA]$^{neg}$ [HLA]$^{neg}$[HPRT]$^{neg}$ [SERCA]$^{neg}$ [DCK]$^{neg}$[PD1]$^{neg}$ [SERCA]$^{neg}$ [DCK]$^{neg}$[CTLA4]$^{neg}$ [SERCA]$^{neg}$ [DCK]$^{neg}$[TIM-3]$^{neg}$ [SERCA]$^{neg}$ [DCK]$^{neg}$[LAG3]$^{neg}$ [SERCA]$^{neg}$ [DCK]$^{neg}$[TIGIT]$^{neg}$ [SERCA]$^{neg}$ [HPRT]$^{neg}$[PD1]$^{neg}$ [SERCA]$^{neg}$ [HPRT]$^{neg}$[CTLA4]$^{neg}$ [SERCA]$^{neg}$ [HPRT]$^{neg}$[TIM-3]$^{neg}$ [SERCA]$^{neg}$ [HPRT]$^{neg}$[LAG3]$^{neg}$ [SERCA]$^{neg}$ [HPRT]$^{neg}$[TIGIT]$^{neg}$ | [SERCA]$^{neg}$ [TCR]$^{neg}$[GR]$^{neg}$ [SERCA]$^{neg}$ [TCR]$^{neg}$[CD52]$^{neg}$ [SERCA]$^{neg}$ [β2m]$^{neg}$[GR]$^{neg}$ [SERCA]$^{neg}$ [β2m]$^{neg}$[CD52]$^{neg}$ [SERCA]$^{neg}$ [HLA]$^{neg}$[GR]$^{neg}$ [SERCA]$^{neg}$ [HLA]$^{neg}$[CD52]$^{neg}$ [SERCA]$^{neg}$ [GR]$^{neg}$[PD1]$^{neg}$ [SERCA]$^{neg}$ [GR]$^{neg}$[CTLA4]$^{neg}$ [SERCA]$^{neg}$ [GR]$^{neg}$[TIM-3]$^{neg}$ [SERCA]$^{neg}$ [GR]$^{neg}$[LAG3]$^{neg}$ [SERCA]$^{neg}$ [GR]$^{neg}$[TIGIT]$^{neg}$ [SERCA]$^{neg}$ [CD52]$^{neg}$[PD1]$^{neg}$ [CD52]$^{neg}$[CTLA4]$^{neg}$ [SERCA]$^{neg}$ [CD52]$^{neg}$[TIM-3]$^{neg}$ [SERCA]$^{neg}$ [CD52]$^{neg}$[LAG3]$^{neg}$ [SERCA]$^{neg}$ [CD52]$^{neg}$[TIGIT]$^{neg}$ |

TABLE 1-continued

Preferred target genes for the production of engineered immune cells with enhanced immune functions according to the present invention:

| Primary target genes | | Genotype of preferred engineered Immune cells | | | | |
|---|---|---|---|---|---|---|
| | Phenotype | Additional KO to lower alloreactivity: [TCR]$^{neg}$ [β2m]$^{neg}$ | Additional KO to inactivate checkpoint inhibitors: [PD1]$^{neg}$ [CTLA4]$^{neg}$ [TIM-3]$^{neg}$ [LAG3]$^{neg}$ [TIGIT]$^{neg}$ | Additional KO to confer resistance to drugs: Purine analogue drugs: [DCK]$^{neg}$ 6 mercaptopurine (6 MP) and 6 thioguanine (6 TG) [HPRT]$^{neg}$ | Resistance to immunodepletion agents: glucocorticoids receptors: [GR]$^{neg}$ Alentuzumab receptor [CD52]$^{neg}$ | |
| Single KO [STAT1]$^{neg}$ Aliases: [CANDF7]$^{neg}$ [IMD31A]$^{neg}$, [IMD31B]$^{neg}$, [IMD31C]$^{neg}$, [ISGF-3]$^{neg}$, [STAT91]$^{neg}$ | Down regulation of immune checkpoint proteins | [STAT1]$^{neg}$ [TCR]$^{neg}$ [STAT1]$^{neg}$[β2m]$^{neg}$ [STAT1]$^{neg}$[HLA]$^{neg}$ [STAT1]$^{neg}$ [TCR]$^{neg}$[β2m]$^{neg}$ [STAT1]$^{neg}$ [TCR]$^{neg}$[HLA]$^{neg}$ | [STAT1]$^{neg}$ [TCR]$^{neg}$[PD1]$^{neg}$ [STAT1]$^{neg}$[CTLA4]$^{neg}$ [TCR]$^{neg}$[CTLA4]$^{neg}$ [STAT1]$^{neg}$ [TCR]$^{neg}$[TIM-3]$^{neg}$ [STAT1]$^{neg}$ [TCR]$^{neg}$[LAG3]$^{neg}$ [STAT1]$^{neg}$ [TCR]$^{neg}$[TIGIT]$^{neg}$ [STAT1]$^{neg}$ [β2m]$^{neg}$[PD1]$^{neg}$ [STAT1]$^{neg}$ [β2m]$^{neg}$[CTLA4]$^{neg}$ [STAT1]$^{neg}$ [β2m]$^{neg}$[TIM-3]$^{neg}$ [STAT1]$^{neg}$ [β2m]$^{neg}$[LAG3]$^{neg}$ [STAT1]$^{neg}$ [β2m]$^{neg}$[TIGIT]$^{neg}$ [STAT1]$^{neg}$ [HLA]$^{neg}$[PD1]$^{neg}$ [HLA]$^{neg}$[CTLA4]$^{neg}$ [STAT1]$^{neg}$ [HLA]$^{neg}$[TIM-3]$^{neg}$ [STAT1]$^{neg}$ [HLA]$^{neg}$[LAG3]$^{neg}$ [STAT1]$^{neg}$ [HLA]$^{neg}$[TIGIT]$^{neg}$ | [STAT1]$^{neg}$ [TCR]$^{neg}$[DCK]$^{neg}$ [STAT1]$^{neg}$ [TCR]$^{neg}$[HPRT]$^{neg}$ [STAT1]$^{neg}$ [β2m]$^{neg}$[DCK]$^{neg}$ [STAT1]$^{neg}$ [β2m]$^{neg}$[HPRT]$^{neg}$ [STAT1]$^{neg}$ [HLA]$^{neg}$[DCK]$^{neg}$ [STAT1]$^{neg}$ [HLA]$^{neg}$[HPRT]$^{neg}$ [STAT1]$^{neg}$ [DCK]$^{neg}$[PD1]$^{neg}$ [STAT1]$^{neg}$ [DCK]$^{neg}$[CTLA4]$^{neg}$ [STAT1]$^{neg}$ [DCK]$^{neg}$[TIM-3]$^{neg}$ [STAT1]$^{neg}$ [DCK]$^{neg}$[LAG3]$^{neg}$ [STAT1]$^{neg}$ [DCK]$^{neg}$[TIGIT]$^{neg}$ [STAT1]$^{neg}$ [HPRT]$^{neg}$[PD1]$^{neg}$ [STAT1]$^{neg}$ [HPRT]$^{neg}$[CTLA4]$^{neg}$ [STAT1]$^{neg}$ [HPRT]$^{neg}$[TIM-3]$^{neg}$ [STAT1]$^{neg}$ [HPRT]$^{neg}$[LAG3]$^{neg}$ [STAT1]$^{neg}$ [HPRT]$^{neg}$[TIGIT]$^{neg}$ | [STAT1]$^{neg}$ [TCR]$^{neg}$[GR]$^{neg}$ [STAT1]$^{neg}$ [TCR]$^{neg}$[CD52]$^{neg}$ [STAT1]$^{neg}$ [β2m]$^{neg}$[GR]$^{neg}$ [STAT1]$^{neg}$ [β2m]$^{neg}$[CD52]$^{neg}$ [STAT1]$^{neg}$ [HLA]$^{neg}$[GR]$^{neg}$ [STAT1]$^{neg}$ [HLA]$^{neg}$[CD52]$^{neg}$ [STAT1]$^{neg}$ [GR]$^{neg}$[PD1]$^{neg}$ [STAT1]$^{neg}$ [GR]$^{neg}$[CTLA4]$^{neg}$ [STAT1]$^{neg}$ [GR]$^{neg}$[TIM-3]$^{neg}$ [STAT1]$^{neg}$ [GR]$^{neg}$[LAG3]$^{neg}$ [STAT1]$^{neg}$ [GR]$^{neg}$[TIGIT]$^{neg}$ [STAT1]$^{neg}$ [CD52]$^{neg}$[PD1]$^{neg}$ [STAT1]$^{neg}$ [CD52]$^{neg}$[CTLA4]$^{neg}$ [STAT1]$^{neg}$ [CD52]$^{neg}$[TIM-3]$^{neg}$ [STAT1]$^{neg}$ [CD52]$^{neg}$[LAG3]$^{neg}$ [STAT1]$^{neg}$ [CD52]$^{neg}$[TIGIT]$^{neg}$ | |
| [STAT3]$^{neg}$ Aliases: [ADMIO]$^{neg}$, [ADMIO1]$^{neg}$, [APRF]$^{neg}$, [HIES]$^{neg}$ | Down regulation of immune checkpoint proteins | [STAT3]$^{neg}$ [TCR]$^{neg}$ [STAT3]$^{neg}$[β2m]$^{neg}$ [STAT3]$^{neg}$[HLA]$^{neg}$ [STAT3]$^{neg}$ [TCR]$^{neg}$[β2m]$^{neg}$ [STAT3]$^{neg}$ [TCR]$^{neg}$[HLA]$^{neg}$ | [STAT3]$^{neg}$ [TCR]$^{neg}$[PD1]$^{neg}$ [STAT3]$^{neg}$[CTLA4]$^{neg}$ [TCR]$^{neg}$[CTLA4]$^{neg}$ [STAT3]$^{neg}$ [TCR]$^{neg}$[TIM-3]$^{neg}$ [STAT3]$^{neg}$ [TCR]$^{neg}$[LAG3]$^{neg}$ [STAT3]$^{neg}$ [TCR]$^{neg}$[TIGIT]$^{neg}$ [STAT3]$^{neg}$ [β2m]$^{neg}$[PD1]$^{neg}$ [STAT3]$^{neg}$ [β2m]$^{neg}$[CTLA4]$^{neg}$ [STAT3]$^{neg}$ [β2m]$^{neg}$[TIM-3]$^{neg}$ [STAT3]$^{neg}$ [β2m]$^{neg}$[LAG3]$^{neg}$ [STAT3]$^{neg}$ [β2m]$^{neg}$[TIGIT]$^{neg}$ [STAT3]$^{neg}$ [HLA]$^{neg}$[PD1]$^{neg}$ [HLA]$^{neg}$[CTLA4]$^{neg}$ [STAT3]$^{neg}$ [HLA]$^{neg}$[TIM-3]$^{neg}$ [STAT3]$^{neg}$ [HLA]$^{neg}$[LAG3]$^{neg}$ [STAT3]$^{neg}$ [HLA]$^{neg}$[TIGIT]$^{neg}$ | [STAT3]$^{neg}$ [TCR]$^{neg}$[DCK]$^{neg}$ [STAT3]$^{neg}$ [TCR]$^{neg}$[HPRT]$^{neg}$ [STAT3]$^{neg}$ [β2m]$^{neg}$[DCK]$^{neg}$ [STAT3]$^{neg}$ [β2m]$^{neg}$[HPRT]$^{neg}$ [STAT3]$^{neg}$ [HLA]$^{neg}$[DCK]$^{neg}$ [STAT3]$^{neg}$ [HLA]$^{neg}$[HPRT]$^{neg}$ [STAT3]$^{neg}$ [DCK]$^{neg}$[PD1]$^{neg}$ [STAT3]$^{neg}$ [DCK]$^{neg}$[CTLA4]$^{neg}$ [STAT3]$^{neg}$ [DCK]$^{neg}$[TIM-3]$^{neg}$ [STAT3]$^{neg}$ [DCK]$^{neg}$[LAG3]$^{neg}$ [STAT3]$^{neg}$ [DCK]$^{neg}$[TIGIT]$^{neg}$ [STAT3]$^{neg}$ [HPRT]$^{neg}$[PD1]$^{neg}$ [STAT3]$^{neg}$ [HPRT]$^{neg}$[CTLA4]$^{neg}$ [STAT3]$^{neg}$ [HPRT]$^{neg}$[TIM-3]$^{neg}$ [STAT3]$^{neg}$ [HPRT]$^{neg}$[LAG3]$^{neg}$ [STAT3]$^{neg}$ [HPRT]$^{neg}$[TIGIT]$^{neg}$ | [STAT3]$^{neg}$ [TCR]$^{neg}$[GR]$^{neg}$ [STAT3]$^{neg}$ [TCR]$^{neg}$[CD52]$^{neg}$ [STAT3]$^{neg}$ [β2m]$^{neg}$[GR]$^{neg}$ [STAT3]$^{neg}$ [β2m]$^{neg}$[CD52]$^{neg}$ [STAT3]$^{neg}$ [HLA]$^{neg}$[GR]$^{neg}$ [STAT3]$^{neg}$ [HLA]$^{neg}$[CD52]$^{neg}$ [STAT3]$^{neg}$ [GR]$^{neg}$[PD1]$^{neg}$ [STAT3]$^{neg}$ [GR]$^{neg}$[CTLA4]$^{neg}$ [STAT3]$^{neg}$ [GR]$^{neg}$[TIM-3]$^{neg}$ [STAT3]$^{neg}$ [GR]$^{neg}$[LAG3]$^{neg}$ [STAT3]$^{neg}$ [GR]$^{neg}$[TIGIT]$^{neg}$ [STAT3]$^{neg}$ [CD52]$^{neg}$[PD1]$^{neg}$ [STAT3]$^{neg}$ [CD52]$^{neg}$[CTLA4]$^{neg}$ [STAT3]$^{neg}$ [CD52]$^{neg}$[TIM-3]$^{neg}$ [STAT3]$^{neg}$ [CD52]$^{neg}$[LAG3]$^{neg}$ [STAT3]$^{neg}$ [CD52]$^{neg}$[TIGIT]$^{neg}$ | |
| [IL27RA]$^{neg}$ Aliases: [CRL1]$^{neg}$, | Down regulation of immune | [IL27RA]$^{neg}$ [TCR]$^{neg}$ [IL27RA]$^{neg}$ [β2m]$^{neg}$ [IL27RA]$^{neg}$ [HLA]$^{neg}$ | [IL27RA]$^{neg}$ [TCR]$^{neg}$[PD1]$^{neg}$ [IL27RA]$^{neg}$ [TCR]$^{neg}$[CTLA4]$^{neg}$ | [IL27RA]$^{neg}$ [TCR]$^{neg}$[DCK]$^{neg}$ [IL27RA]$^{neg}$ [TCR]$^{neg}$[HPRT]$^{neg}$ [IL27RA]$^{neg}$ [β2m]$^{neg}$[DCK]$^{neg}$ | [IL27RA]$^{neg}$ [TCR]$^{neg}$[GR]$^{neg}$ [IL27RA]$^{neg}$ [TCR]$^{neg}$[CD52]$^{neg}$ [IL27RA]$^{neg}$ [β2m]$^{neg}$[GR]$^{neg}$ | |

TABLE 1-continued

Genotype of preferred engineered Immune cells

Preferred target genes for the production of engineered immune cells with enhanced immune functions according to the present invention:

| Primary target genes | Phenotype | Additional KO to lower alloreactivity: [TCR]$^{neg}$ [β2m]$^{neg}$ | Additional KO to inactivate checkpoint inhibitors: [PD1]$^{neg}$ [CTLA4]$^{neg}$ [TIM-3]$^{neg}$ [LAG3]$^{neg}$ [TIGIT]$^{neg}$ | Additional KO to confer resistance to drugs: Purine analogue drugs: [DCK]$^{neg}$ 6 mercaptopurine (6 MP) and 6 thioguanine (6 TG) [HPRT]$^{neg}$ | Resistance to immunodepletion agents: glucocorticoids receptors: [GR]$^{neg}$ Alentuzumab receptor [CD52]$^{neg}$ |
|---|---|---|---|---|---|
| Single KO | checkpoint proteins | [HLA]$^{neg}$ | [TIGIT]$^{neg}$ | [HPRT]$^{neg}$ | |
| IL-[27RA]$^{neg}$, [IL27R]$^{neg}$, [TCCR]$^{neg}$, [WSX1]$^{neg}$, [zeytor]$^{neg}$ | | [IL27RA]$^{neg}$ [TCR]$^{neg}$[β2m]$^{neg}$ [IL27RA]$^{neg}$ [TCR]$^{neg}$[HLA]$^{neg}$ | [IL27RA]$^{neg}$ [TCR]$^{neg}$[TIM-3]$^{neg}$ [IL27RA]$^{neg}$ [TCR]$^{neg}$[LAG3]$^{neg}$ [IL27RA]$^{neg}$ [TCR]$^{neg}$[TIGIT]$^{neg}$ [IL27RA]$^{neg}$ [TCR]$^{neg}$[PD1]$^{neg}$[CTLA4]$^{neg}$ [IL27RA]$^{neg}$ [β2m]$^{neg}$[PD1]$^{neg}$ [IL27RA]$^{neg}$ [β2m]$^{neg}$[TIM-3]$^{neg}$ [IL27RA]$^{neg}$ [β2m]$^{neg}$[LAG3]$^{neg}$ [IL27RA]$^{neg}$ [β2m]$^{neg}$[TIGIT]$^{neg}$ [β2m]$^{neg}$[CTLA4]$^{neg}$ [IL27RA]$^{neg}$ [HLA]$^{neg}$[PD1]$^{neg}$ [IL27RA]$^{neg}$ [HLA]$^{neg}$[TIM-3]$^{neg}$ [IL27RA]$^{neg}$ [HLA]$^{neg}$[LAG3]$^{neg}$ [HLA]$^{neg}$[CTLA4]$^{neg}$ [IL27RA]$^{neg}$ [HLA]$^{neg}$[TIGIT]$^{neg}$ | [IL27RA]$^{neg}$ [β2m]$^{neg}$[HPRT]$^{neg}$ [IL27RA]$^{neg}$ [HLA]$^{neg}$[DCK]$^{neg}$ [IL27RA]$^{neg}$ [HLA]$^{neg}$[HPRT]$^{neg}$ [IL27RA]$^{neg}$ [DCK]$^{neg}$[PD1]$^{neg}$ [IL27RA]$^{neg}$ [DCK]$^{neg}$[CTLA4]$^{neg}$ [IL27RA]$^{neg}$ [DCK]$^{neg}$[TIM-3]$^{neg}$ [IL27RA]$^{neg}$ [DCK]$^{neg}$[LAG3]$^{neg}$ [IL27RA]$^{neg}$ [DCK]$^{neg}$[TIGIT]$^{neg}$ [IL27RA]$^{neg}$ [HPRT]$^{neg}$[PD1]$^{neg}$ [HPRT]$^{neg}$[CTLA4]$^{neg}$ [IL27RA]$^{neg}$ [HPRT]$^{neg}$[TIM-3]$^{neg}$ [IL27RA]$^{neg}$ [HPRT]$^{neg}$[LAG3]$^{neg}$ [IL27RA]$^{neg}$ [HPRT]$^{neg}$[TIGIT]$^{neg}$ | [IL27RA]$^{neg}$ [β2m]$^{neg}$[CD52]$^{neg}$ [IL27RA]$^{neg}$ [HLA]$^{neg}$[GR]$^{neg}$ [IL27RA]$^{neg}$ [HLA]$^{neg}$[CD52]$^{neg}$ [IL27RA]$^{neg}$ [GR]$^{neg}$[PD1]$^{neg}$ [GR]$^{neg}$[CTLA4]$^{neg}$ [IL27RA]$^{neg}$ [GR]$^{neg}$[TIM-3]$^{neg}$ [IL27RA]$^{neg}$ [GR]$^{neg}$[LAG3]$^{neg}$ [IL27RA]$^{neg}$ [GR]$^{neg}$[TIGIT]$^{neg}$ [IL27RA]$^{neg}$ [CD52]$^{neg}$[PD1]$^{neg}$ [CD52]$^{neg}$[CTLA4]$^{neg}$ [IL27RA]$^{neg}$ [CD52]$^{neg}$[TIM-3]$^{neg}$ [CD52]$^{neg}$[LAG3]$^{neg}$ [IL27RA]$^{neg}$ [CD52]$^{neg}$[TIGIT]$^{neg}$ |
| [ILT2]$^{neg}$ Aliases: [LILRB1]$^{neg}$ [CD85J]$^{neg}$ [ILT1-2]$^{neg}$ [LIR-1]$^{neg}$ [LIR1]$^{neg}$ [MIR-7]$^{neg}$ [MIR-7]$^{neg}$ [PIR-B]$^{neg}$ [PIRB]$^{neg}$ | Modulated interaction with HLA-G | [ILT2]$^{neg}$ [TCR]$^{neg}$ [ILT2]$^{neg}$ [β2m]$^{neg}$ [ILT2]$^{neg}$ [TCR]$^{neg}$[HLA]$^{neg}$ [ILT2]$^{neg}$ [TCR]$^{neg}$[β2m]$^{neg}$ [ILT2]$^{neg}$ [TCR]$^{neg}$[HLA]$^{neg}$ | [ILT2]$^{neg}$ [TCR]$^{neg}$[PD1]$^{neg}$ [ILT2]$^{neg}$ [TCR]$^{neg}$[CTLA4]$^{neg}$ [ILT2]$^{neg}$ [TCR]$^{neg}$[TIM-3]$^{neg}$ [ILT2]$^{neg}$ [TCR]$^{neg}$[LAG3]$^{neg}$ [ILT2]$^{neg}$ [TCR]$^{neg}$[TIGIT]$^{neg}$ [ILT2]$^{neg}$ [β2m]$^{neg}$[PD1]$^{neg}$ [ILT2]$^{neg}$ [β2m]$^{neg}$[CTLA4]$^{neg}$ [ILT2]$^{neg}$ [β2m]$^{neg}$[TIM-3]$^{neg}$ [ILT2]$^{neg}$ [β2m]$^{neg}$[LAG3]$^{neg}$ [ILT2]$^{neg}$ [β2m]$^{neg}$[TIGIT]$^{neg}$ [ILT2]$^{neg}$ [HLA]$^{neg}$[PD1]$^{neg}$ [ILT2]$^{neg}$ [HLA]$^{neg}$[CTLA4]$^{neg}$ [ILT2]$^{neg}$ [HLA]$^{neg}$[TIM-3]$^{neg}$ [ILT2]$^{neg}$ [HLA]$^{neg}$[LAG3]$^{neg}$ [ILT2]$^{neg}$ [HLA]$^{neg}$[TIGIT]$^{neg}$ | [ILT2]$^{neg}$ [TCR]$^{neg}$[DCK]$^{neg}$ [ILT2]$^{neg}$ [TCR]$^{neg}$[HPRT]$^{neg}$ [ILT2]$^{neg}$ [β2m]$^{neg}$[DCK]$^{neg}$ [ILT2]$^{neg}$ [HLA]$^{neg}$[DCK]$^{neg}$ [ILT2]$^{neg}$ [HLA]$^{neg}$[HPRT]$^{neg}$ [ILT2]$^{neg}$ [DCK]$^{neg}$[PD1]$^{neg}$ [ILT2]$^{neg}$ [DCK]$^{neg}$[CTLA4]$^{neg}$ [ILT2]$^{neg}$ [DCK]$^{neg}$[TIM-3]$^{neg}$ [ILT2]$^{neg}$ [DCK]$^{neg}$[LAG3]$^{neg}$ [ILT2]$^{neg}$ [DCK]$^{neg}$[TIGIT]$^{neg}$ [ILT2]$^{neg}$ [HPRT]$^{neg}$[PD1]$^{neg}$ [ILT2]$^{neg}$ [HPRT]$^{neg}$[CTLA4]$^{neg}$ [ILT2]$^{neg}$ [HPRT]$^{neg}$[TIM-3]$^{neg}$ [ILT2]$^{neg}$ [HPRT]$^{neg}$[LAG3]$^{neg}$ [ILT2]$^{neg}$ [HPRT]$^{neg}$[TIGIT]$^{neg}$ | [ILT2]$^{neg}$ [TCR]$^{neg}$[GR]$^{neg}$ [ILT2]$^{neg}$ [TCR]$^{neg}$[CD52]$^{neg}$ [ILT2]$^{neg}$ [β2m]$^{neg}$[GR]$^{neg}$ [ILT2]$^{neg}$ [β2m]$^{neg}$[CD52]$^{neg}$ [ILT2]$^{neg}$ [HLA]$^{neg}$[GR]$^{neg}$ [ILT2]$^{neg}$ [HLA]$^{neg}$[CD52]$^{neg}$ [ILT2]$^{neg}$ [GR]$^{neg}$[PD1]$^{neg}$ [ILT2]$^{neg}$ [GR]$^{neg}$[CTLA4]$^{neg}$ [ILT2]$^{neg}$ [GR]$^{neg}$[TIM-3]$^{neg}$ [ILT2]$^{neg}$ [GR]$^{neg}$[LAG3]$^{neg}$ [ILT2]$^{neg}$ [GR]$^{neg}$[TIGIT]$^{neg}$ [ILT2]$^{neg}$ [CD52]$^{neg}$[PD1]$^{neg}$ [ILT2]$^{neg}$ [CD52]$^{neg}$[CTLA4]$^{neg}$ [ILT2]$^{neg}$ [CD52]$^{neg}$[TIM-3]$^{neg}$ [ILT2]$^{neg}$ [CD52]$^{neg}$[LAG3]$^{neg}$ [ILT2]$^{neg}$ [CD52]$^{neg}$[TIGIT]$^{neg}$ |
| [ILT4]$^{neg}$ Aliases: [LILRB2]$^{neg}$ [CD85D]$^{neg}$ [ILT-4]$^{neg}$ [LIR-2]$^{neg}$, | Modulated interaction with HLA-G | [ILT4]$^{neg}$ [TCR]$^{neg}$ [ILT4]$^{neg}$ [β2m]$^{neg}$ [ILT4]$^{neg}$ [TCR]$^{neg}$[HLA]$^{neg}$ [ILT4]$^{neg}$ [TCR]$^{neg}$[β2m]$^{neg}$ [ILT4]$^{neg}$ [TCR]$^{neg}$[HLA]$^{neg}$ | [ILT4]$^{neg}$ [TCR]$^{neg}$[PD1]$^{neg}$ [ILT4]$^{neg}$ [TCR]$^{neg}$[CTLA4]$^{neg}$ [ILT4]$^{neg}$ [TCR]$^{neg}$[TIM-3]$^{neg}$ [ILT4]$^{neg}$ [TCR]$^{neg}$[LAG3]$^{neg}$ [ILT4]$^{neg}$ [TCR]$^{neg}$[TIGIT]$^{neg}$ [ILT4]$^{neg}$ [β2m]$^{neg}$[PD1]$^{neg}$ | [ILT4]$^{neg}$ [TCR]$^{neg}$[DCK]$^{neg}$ [ILT4]$^{neg}$ [TCR]$^{neg}$[HPRT]$^{neg}$ [ILT4]$^{neg}$ [β2m]$^{neg}$[DCK]$^{neg}$ [ILT4]$^{neg}$ [HLA]$^{neg}$[DCK]$^{neg}$ [ILT4]$^{neg}$ [HLA]$^{neg}$[HPRT]$^{neg}$ | [ILT4]$^{neg}$ [TCR]$^{neg}$[GR]$^{neg}$ [ILT4]$^{neg}$ [TCR]$^{neg}$[CD52]$^{neg}$ [ILT4]$^{neg}$ [β2m]$^{neg}$[GR]$^{neg}$ [ILT4]$^{neg}$ [β2m]$^{neg}$[CD52]$^{neg}$ [ILT4]$^{neg}$ [HLA]$^{neg}$[GR]$^{neg}$ [ILT4]$^{neg}$ [HLA]$^{neg}$[CD52]$^{neg}$ |

TABLE 1-continued

Preferred target genes for the production of engineered immune cells with enhanced immune functions according to the present invention:

Genotype of preferred engineered Immune cells

| Primary target genes | Phenotype | Additional KO to lower alloreactivity: [TCR]^neg [β2m]^neg | Additional KO to inactivate checkpoint inhibitors: [PD1]^neg [CTLA4]^neg [TIM-3]^neg [LAG3]^neg [TIGIT]^neg | Additional KO to confer resistance to drugs: Purine analogue drugs: [DCK]^neg 6 mercaptopurine (6 MP) and 6 thioguanine (6 TG) [HPRT]^neg | Resistance to immunodepletion agents: glucocorticoids receptors: [GR]^neg Alemtuzumab receptor [CD52]^neg |
|---|---|---|---|---|---|
| Single KO [LIR2]^neg, [MIR-10]^neg, [MIR10]^neg | | [HLA]^neg | | | [ILT4]^neg [DCK][PD1]^neg  [ILT4]^neg [GR]^neg[PD1]^neg |
| | | | | | [ILT4]^neg [DCK]^neg[CTLA4]^neg  [ILT4]^neg [GR]^neg[CTLA4]^neg |
| | | | | | [ILT4]^neg [DCK]^neg[TIM-3]^neg  [ILT4]^neg [GR]^neg[TIM-3]^neg |
| | | | | | [ILT4]^neg [DCK]^neg[LAG3]^neg  [ILT4]^neg [GR]^neg[LAG3]^neg |
| | | | | | [ILT4]^neg [DCK]^neg[TIGIT]^neg  [ILT4]^neg [GR]^neg[TIGIT]^neg |
| | | | | | [ILT4]^neg [HPRT][PD1]^neg  [ILT4]^neg [CD52]^neg[PD1]^neg |
| | | | | | [ILT4]^neg [HPRT]^neg[CTLA4]^neg  [ILT4]^neg [CD52]^neg[CTLA4]^neg |
| | | | | | [ILT4]^neg [HPRT]^neg[TIM-3]^neg  [ILT4]^neg [CD52]^neg[TIM-3]^neg |
| | | | | | [ILT4]^neg [HPRT]^neg[LAG3]^neg  [ILT4]^neg [CD52]^neg[LAG3]^neg |
| | | | | | [ILT4]^neg [HPRT]^neg[TIGIT]^neg  [ILT4]^neg [CD52]^neg[TIGIT]^neg |
| [SEMA7A]^neg Aliases: [CD108]^neg, [CDw108]^neg, [H-SEMA-K1]^neg, [H-Sema-L]^neg, [JMH]^neg, [SEMAK1]^neg, [SEMAL]^neg | Increased Immune cells proliferation | [SEMA7A]^neg [TCR]^neg  [SEMA7A]^neg [β2m]^neg  [SEMA7A]^neg [HLA]^neg  [TCR]^neg[β2m]^neg  [SEMA7A]^neg  [TCR]^neg[HLA]^neg | [SEMA7A]^neg [TCR]^neg[PD1]^neg  [SEMA7A]^neg  [TCR]^neg[CTLA4]^neg  [SEMA7A]^neg [TCR]^neg[TIM-3]^neg  [SEMA7A]^neg  [SEMA7A]^neg [LAG3]^neg  [TCR]^neg[LAG3]^neg  [SEMA7A]^neg  [SEMA7A]^neg [TIGIT]^neg  [TCR]^neg[TIGIT]^neg  [SEMA7A]^neg [β2m]^neg[PD1]^neg  [SEMA7A]^neg  [β2m]^neg[CTLA4]^neg  [SEMA7A]^neg [β2m]^neg[TIM-3]^neg  [SEMA7A]^neg [LAG3]^neg  [β2m]^neg [LAG3]^neg  [SEMA7A]^neg  [β2m]^neg [TIGIT]^neg  [HLA]^neg[PD1]^neg  [SEMA7A]^neg  [HLA]^neg[CTLA4]^neg  [SEMA7A]^neg  [HLA]^neg[TIM-3]^neg  [SEMA7A]^neg  [HLA]^neg[LAG3]^neg  [SEMA7A]^neg  [HLA]^neg[TIGIT]^neg | [SEMA7A]^neg [TCR]^neg[DCK]^neg  [SEMA7A]^neg [TCR]^neg[HPRT]  [SEMA7A]^neg [β2m]^neg[DCK]^neg  [SEMA7A]^neg [β2m]^neg[HPRT]  [SEMA7A]^neg [HLA]^neg[DCK]  [SEMA7A]^neg [HLA]^neg[HPRT]  [DCK]^neg[CTLA4]^neg  [SEMA7A]^neg  [SEMA7A]^neg [DCK]^neg[TIM-3]^neg  [SEMA7A]^neg [DCK]^neg[LAG3]^neg  [SEMA7A]^neg [DCK]^neg[TIGIT]^neg  [SEMA7A]^neg [HPRT]^neg[PD1]^neg  [HPRT]^neg[CTLA4]^neg  [SEMA7A]^neg  [SEMA7A]^neg [HPRT]^neg[TIM-3]^neg  [HPRT]^neg[LAG3]^neg  [SEMA7A]^neg  [HPRT]^neg[TIGIT]^neg  [SEMA7A]^neg | [SEMA7A]^neg [TCR]^neg[GR]^neg  [TCR]^neg[CD52]^neg  [SEMA7A]^neg  [SEMA7A]^neg [β2m]^neg[GR]^neg  [SEMA7A]^neg [β2m]^neg[CD52]  [SEMA7A]^neg [HLA]^neg[GR]^neg  [SEMA7A]^neg [HLA]^neg[CD52]  [HLA]^neg[CD52]  [SEMA7A]^neg  [SEMA7A]^neg [GR]^neg[PD1]^neg  [GR]^neg[CTLA4]^neg  [SEMA7A]^neg  [SEMA7A]^neg [GR]^neg[TIM-3]^neg  [GR]^neg[LAG3]  [SEMA7A]^neg  [GR]^neg[TIGIT]  [SEMA7A]^neg  [CD52]^neg[PD1]^neg  [SEMA7A]^neg  [CD52]^neg[CTLA4]^neg  [SEMA7A]^neg  [CD52]^neg[TIM-3]^neg  [SEMA7A]^neg  [CD52]^neg[LAG3]  [SEMA7A]^neg  [CD52]^neg[TIGIT]  [SEMA7A]^neg |
| [PEA15]^neg Aliases: [HMAT1]^neg, [HUMMAT1H]^neg, | | [PEA15]^neg [TCR]^neg  [PEA15]^neg[β2m]^neg  [PEA15]^neg[HLA]^neg  [PEA15]^neg | [PEA15]^neg [TCR]^neg[PD1]^neg  [PEA15]^neg  [TCR]^neg[CTLA4]^neg  [PEA15]^neg [TCR]^neg[TIM-3]^neg | [PEA15]^neg [TCR]^neg[DCK]^neg  [PEA15]^neg [TCR]^neg[HPRT]^neg  [PEA15]^neg [β2m][DCK]^neg  [PEA15]^neg [β2m][HPRT]^neg | [PEA15]^neg [TCR]^neg[GR]^neg  [PEA15]^neg [TCR]^neg[CD52]^neg  [PEA15]^neg [β2m][GR]^neg  [PEA15]^neg [β2m][CD52]^neg |

TABLE 1-continued

Preferred target genes for the production of engineered immune cells with enhanced immune functions according to the present invention:

Genotype of preferred engineered Immune cells

| Primary target genes | | Additional KO to lower alloreactivity: [TCR]$^{neg}$ [β2m]$^{neg}$ [HLA]$^{neg}$ | Additional KO to inactivate checkpoint inhibitors: [CTLA4]$^{neg}$ [TIM-3]$^{neg}$ [LAG3]$^{neg}$ [TIGIT]$^{neg}$ | Additional KO to confer resistance to drugs: Purine analogue drugs: [DCK]$^{neg}$ 6 mercaptopurine (6 MP) and 6 thioguanine (6 TG): [HPRT]$^{neg}$ | Resistance to immunodepletion agents: glucocorticoids receptors: [GR]$^{neg}$ Alemtuzumab receptor [CD52]$^{neg}$ |
|---|---|---|---|---|---|
| Single KO | Phenotype | | | | |
| [MAT1]$^{neg}$, [MAT1H]$^{neg}$, [PEA-15]$^{neg}$, [PED]$^{neg}$ | | [TCR]$^{neg}$[β2m]$^{neg}$ [PEA15]$^{neg}$ [TCR]$^{neg}$[HLA]$^{neg}$ | [PEA15]$^{neg}$ [TCR]$^{neg}$[LAG3]$^{neg}$ [PEA15]$^{neg}$ [TCR]$^{neg}$[TIGIT]$^{neg}$ [PEA15]$^{neg}$ [β2m]$^{neg}$[CTLA4]$^{neg}$ [PEA15]$^{neg}$ [β2m]$^{neg}$[TIM-3]$^{neg}$ [PEA15]$^{neg}$ [β2m]$^{neg}$[LAG3]$^{neg}$ [PEA15]$^{neg}$ [β2m]$^{neg}$[TIGIT]$^{neg}$ [PEA15]$^{neg}$ [HLA]$^{neg}$[PD1]$^{neg}$ [PEA15]$^{neg}$ [HLA]$^{neg}$[CTLA4]$^{neg}$ [PEA15]$^{neg}$ [HLA]$^{neg}$[TIM-3]$^{neg}$ [PEA15]$^{neg}$ [HLA]$^{neg}$[LAG3]$^{neg}$ [PEA15]$^{neg}$ [HLA]$^{neg}$[TIGIT]$^{neg}$ | [PEA15]$^{neg}$ [HLA]$^{neg}$[DCK]$^{neg}$ [PEA15]$^{neg}$ [HLA]$^{neg}$[HPRT]$^{neg}$ [PEA15]$^{neg}$ [DCK]$^{neg}$[PD1]$^{neg}$ [PEA15]$^{neg}$ [DCK]$^{neg}$[CTLA4]$^{neg}$ [PEA15]$^{neg}$ [DCK]$^{neg}$[TIM-3]$^{neg}$ [PEA15]$^{neg}$ [DCK]$^{neg}$[LAG3]$^{neg}$ [PEA15]$^{neg}$ [DCK]$^{neg}$[TIGIT]$^{neg}$ [PEA15]$^{neg}$ [HPRT]$^{neg}$[PD1]$^{neg}$ [PEA15]$^{neg}$ [HPRT]$^{neg}$[CTLA4]$^{neg}$ [PEA15]$^{neg}$ [HPRT]$^{neg}$[TIM-3]$^{neg}$ [PEA15]$^{neg}$ [HPRT]$^{neg}$[LAG3]$^{neg}$ [PEA15]$^{neg}$ [HPRT]$^{neg}$[TIGIT]$^{neg}$ | [PEA15]$^{neg}$ [HLA]$^{neg}$[GR]$^{neg}$ [PEA15]$^{neg}$ [HLA]$^{neg}$[CD52]$^{neg}$ [PEA15]$^{neg}$ [GR]$^{neg}$[PD1]$^{neg}$ [PEA15]$^{neg}$ [GR]$^{neg}$[CTLA4]$^{neg}$ [PEA15]$^{neg}$ [GR]$^{neg}$[TIM-3]$^{neg}$ [PEA15]$^{neg}$ [GR]$^{neg}$[LAG3]$^{neg}$ [PEA15]$^{neg}$ [GR]$^{neg}$[TIGIT]$^{neg}$ [PEA15]$^{neg}$ [CD52]$^{neg}$[PD1]$^{neg}$ [CD52]$^{neg}$[CTLA4]$^{neg}$ [PEA15]$^{neg}$ [CD52]$^{neg}$[TIM-3]$^{neg}$ [PEA15]$^{neg}$ [CD52]$^{neg}$[LAG3]$^{neg}$ [CD52]$^{neg}$[TIGIT]$^{neg}$ |
| [SHARPIN]$^{neg}$ Aliases: [SIPL1]$^{neg}$ | Increased immune cells proliferation | [SHARPIN]$^{neg}$ [TCR]$^{neg}$ [SHARPIN]$^{neg}$[β2m]$^{neg}$ [SHARPIN]$^{neg}$[HLA]$^{neg}$ [SHARPIN]$^{neg}$ [TCR]$^{neg}$[β2m]$^{neg}$ [SHARPIN]$^{neg}$ [TCR]$^{neg}$[HLA]$^{neg}$ | [SHARPIN]$^{neg}$ [TCR]$^{neg}$[PD1]$^{neg}$ [SHARPIN]$^{neg}$ [TCR]$^{neg}$[CTLA4]$^{neg}$ [SHARPIN]$^{neg}$ [TCR]$^{neg}$[TIM-3]$^{neg}$ [SHARPIN]$^{neg}$ [TCR]$^{neg}$[LAG3]$^{neg}$ [SHARPIN]$^{neg}$ [TCR]$^{neg}$[TIGIT]$^{neg}$ [SHARPIN]$^{neg}$ [β2m]$^{neg}$[PD1]$^{neg}$ [SHARPIN]$^{neg}$ [β2m]$^{neg}$[CTLA4]$^{neg}$ [SHARPIN]$^{neg}$ [β2m]$^{neg}$[TIM-3]$^{neg}$ [SHARPIN]$^{neg}$ [β2m]$^{neg}$[LAG3]$^{neg}$ [SHARPIN]$^{neg}$ [HLA]$^{neg}$[PD1]$^{neg}$ [SHARPIN]$^{neg}$ [HLA]$^{neg}$[CTLA4]$^{neg}$ [SHARPIN]$^{neg}$ [HLA]$^{neg}$[TIGIT]$^{neg}$ | [SHARPIN]$^{neg}$ [TCR]$^{neg}$[DCK]$^{neg}$ [SHARPIN]$^{neg}$ [TCR]$^{neg}$[HPRT]$^{neg}$ [SHARPIN]$^{neg}$ [β2m]$^{neg}$[DCK]$^{neg}$ [SHARPIN]$^{neg}$ [β2m]$^{neg}$[HPRT]$^{neg}$ [SHARPIN]$^{neg}$ [HLA]$^{neg}$[DCK]$^{neg}$ [SHARPIN]$^{neg}$ [HLA]$^{neg}$[HPRT]$^{neg}$ [SHARPIN]$^{neg}$ [DCK]$^{neg}$[PD1]$^{neg}$ [DCK]$^{neg}$[CTLA4]$^{neg}$ [SHARPIN]$^{neg}$ [DCK]$^{neg}$[TIM-3]$^{neg}$ [SHARPIN]$^{neg}$ [DCK]$^{neg}$[LAG3]$^{neg}$ [DCK]$^{neg}$[TIGIT]$^{neg}$ [SHARPIN]$^{neg}$ [HPRT]$^{neg}$[PD1]$^{neg}$ [HPRT]$^{neg}$[CTLA4]$^{neg}$ [SHARPIN]$^{neg}$ [HPRT]$^{neg}$[TIM-3]$^{neg}$ [SHARPIN]$^{neg}$ [HPRT]$^{neg}$[LAG3]$^{neg}$ [HPRT]$^{neg}$[TIGIT]$^{neg}$ | [SHARPIN]$^{neg}$ [TCR]$^{neg}$[GR]$^{neg}$ [SHARPIN]$^{neg}$ [TCR]$^{neg}$[CD52]$^{neg}$ [TCR]$^{neg}$[CD52]$^{neg}$ [SHARPIN]$^{neg}$ [β2m]$^{neg}$[GR]$^{neg}$ [β2m]$^{neg}$[CD52]$^{neg}$ [SHARPIN]$^{neg}$ [HLA]$^{neg}$[GR]$^{neg}$ [HLA]$^{neg}$[CD52]$^{neg}$ [SHARPIN]$^{neg}$ [GR]$^{neg}$[PD1]$^{neg}$ [GR]$^{neg}$[CTLA4]$^{neg}$ [SHARPIN]$^{neg}$ [GR]$^{neg}$[TIM-3]$^{neg}$ [GR]$^{neg}$[LAG3]$^{neg}$ [SHARPIN]$^{neg}$ [GR]$^{neg}$[TIGIT]$^{neg}$ [CD52]$^{neg}$[PD1]$^{neg}$ [SHARPIN]$^{neg}$ [CD52]$^{neg}$[CTLA4]$^{neg}$ [CD52]$^{neg}$[TIM-3]$^{neg}$ [SHARPIN]$^{neg}$ [CD52]$^{neg}$[LAG3]$^{neg}$ |

TABLE 1-continued

Preferred target genes for the production of engineered immune cells with enhanced immune functions according to the present invention:

| Primary target genes | Phenotype | Genotype of preferred engineered Immune cells | | | |
|---|---|---|---|---|---|
| | | Additional KO to lower alloreactivity: [TCR]$^{neg}$ [β2m]$^{neg}$ | Additional KO to inactivate checkpoint inhibitors: [PD1]$^{neg}$ [CTLA4]$^{neg}$ [TIM-3]$^{neg}$ [LAG3]$^{neg}$ | Additional KO to confer resistance to drugs: Purine analogue drugs: [DCK]$^{neg}$ 6 mercaptopurine (6 MP) and 6 thioguanine (6 TG): [HPRT]$^{neg}$ | Resistance to immunodepletion agents: glucocorticoids receptors: [GR]$^{neg}$ Alemtuzumab receptor [CD52]$^{neg}$ |
| Single KO | | [HLA]$^{neg}$ | [TIGIT]$^{neg}$ | | [SHARPIN]$^{neg}$ [CD52]$^{neg}$[TIGIT]$^{neg}$ |
| [RICTOR]$^{neg}$ Aliases: [AVO3]$^{neg}$, [PIA]$^{neg}$, [hAVO3]$^{neg}$ | Increased immune cells proliferation | [RICTOR]$^{neg}$ [TCR]$^{neg}$ [RICTOR]$^{neg}$ [β2m]$^{neg}$ [RICTOR]$^{neg}$ [HLA]$^{neg}$ [RICTOR]$^{neg}$ [TCR]$^{neg}$[β2m]$^{neg}$ [RICTOR]$^{neg}$ [TCR]$^{neg}$[HLA]$^{neg}$ | [HLA]$^{neg}$[TIM-3]$^{neg}$ [SHARPIN]$^{neg}$ [HLA]$^{neg}$[LAG3]$^{neg}$ [SHARPIN]$^{neg}$ [HLA]$^{neg}$[TIGIT]$^{neg}$ [RICTOR]$^{neg}$ [TCR]$^{neg}$[PD1]$^{neg}$ [RICTOR]$^{neg}$ [TCR]$^{neg}$[CTLA4]$^{neg}$ [TCR]$^{neg}$[CTLA4]$^{neg}$ [RICTOR]$^{neg}$ [TCR]$^{neg}$[TIM-3]$^{neg}$ [RICTOR]$^{neg}$ [TCR]$^{neg}$[LAG3]$^{neg}$ [TCR]$^{neg}$[LAG3]$^{neg}$ [RICTOR]$^{neg}$ [TCR]$^{neg}$[TIGIT]$^{neg}$ [TCR]$^{neg}$[TIGIT]$^{neg}$ [RICTOR]$^{neg}$ [β2m]$^{neg}$[PD1]$^{neg}$ [RICTOR]$^{neg}$ [β2m]$^{neg}$[CTLA4]$^{neg}$ [β2m]$^{neg}$[CTLA4]$^{neg}$ [RICTOR]$^{neg}$ [β2m]$^{neg}$[TIM-3]$^{neg}$ [RICTOR]$^{neg}$ [HLA]$^{neg}$[PD1]$^{neg}$ [RICTOR]$^{neg}$ [HLA]$^{neg}$[CTLA4]$^{neg}$ [RICTOR]$^{neg}$ [HLA]$^{neg}$[TIM-3]$^{neg}$ [HLA]$^{neg}$[LAG3]$^{neg}$ [RICTOR]$^{neg}$ [HLA]$^{neg}$[TIGIT]$^{neg}$ | [RICTOR]$^{neg}$ [TCR]$^{neg}$[DCK]$^{neg}$ [RICTOR]$^{neg}$ [TCR]$^{neg}$[HPRT]$^{neg}$ [RICTOR]$^{neg}$ [β2m]$^{neg}$[DCK]$^{neg}$ [RICTOR]$^{neg}$ [β2m]$^{neg}$[HPRT]$^{neg}$ [RICTOR]$^{neg}$ [HLA]$^{neg}$[DCK]$^{neg}$ [RICTOR]$^{neg}$ [HLA]$^{neg}$[HPRT]$^{neg}$ [RICTOR]$^{neg}$ [DCK]$^{neg}$[PD1]$^{neg}$ [RICTOR]$^{neg}$ [DCK]$^{neg}$[CTLA4]$^{neg}$ [RICTOR]$^{neg}$ [DCK]$^{neg}$[TIM-3]$^{neg}$ [RICTOR]$^{neg}$ [DCK]$^{neg}$[LAG3]$^{neg}$ [RICTOR]$^{neg}$ [DCK]$^{neg}$[TIGIT]$^{neg}$ [RICTOR]$^{neg}$ [HPRT]$^{neg}$[PD1]$^{neg}$ HPRT]$^{neg}$[CTLA4]$^{neg}$ [RICTOR]$^{neg}$ [HPRT]$^{neg}$[TIM-3]$^{neg}$ [RICTOR]$^{neg}$ [HPRT]$^{neg}$[LAG3]$^{neg}$ [RICTOR]$^{neg}$ [HPRT]$^{neg}$[TIGIT]$^{neg}$ | [RICTOR]$^{neg}$ [TCR]$^{neg}$[GR]$^{neg}$ [RICTOR]$^{neg}$ [TCR]$^{neg}$[CD52]$^{neg}$ [TCR]$^{neg}$[CD52]$^{neg}$ [RICTOR]$^{neg}$ [β2m]$^{neg}$[GR]$^{neg}$ [β2m]$^{neg}$[CD52]$^{neg}$ [RICTOR]$^{neg}$ [HLA]$^{neg}$[GR]$^{neg}$ [RICTOR]$^{neg}$ [HLA]$^{neg}$[CD52]$^{neg}$ [RICTOR]$^{neg}$ [GR]$^{neg}$[PD1]$^{neg}$ [RICTOR]$^{neg}$ [GR]$^{neg}$[TIGIT]$^{neg}$ [GR]$^{neg}$[CTLA4]$^{neg}$ [RICTOR]$^{neg}$ [GR]$^{neg}$[TIM-3]$^{neg}$ [RICTOR]$^{neg}$ [GR]$^{neg}$[LAG3]$^{neg}$ [RICTOR]$^{neg}$ [GR]$^{neg}$[TIGIT]$^{neg}$ [CD52]$^{neg}$[PD1]$^{neg}$ [RICTOR]$^{neg}$ [CD52]$^{neg}$[CTLA4]$^{neg}$ [RICTOR]$^{neg}$ [CD52]$^{neg}$[TIM-3]$^{neg}$ [RICTOR]$^{neg}$ [CD52]$^{neg}$[LAG3]$^{neg}$ [RICTOR]$^{neg}$ [CD52]$^{neg}$[TIGIT]$^{neg}$ [RICTOR]$^{neg}$ |
| [JAK2]$^{neg}$ Aliases: [JTK10]$^{neg}$, [THCYT3]$^{neg}$ | Reduced alloreactivity | [JAK2]$^{neg}$ [TCR]$^{neg}$ [JAK2]$^{neg}$ [β2m]$^{neg}$ [JAK2]$^{neg}$ [HLA]$^{neg}$ [JAK2]$^{neg}$ [TCR]$^{neg}$[β2m]$^{neg}$ [JAK2]$^{neg}$ [TCR]$^{neg}$[HLA]$^{neg}$ | [JAK2]$^{neg}$ [TCR]$^{neg}$[PD1]$^{neg}$ [JAK2]$^{neg}$ [TCR]$^{neg}$[CTLA4]$^{neg}$ [JAK2]$^{neg}$ [TCR]$^{neg}$[TIM-3]$^{neg}$ [JAK2]$^{neg}$ [TCR]$^{neg}$[LAG3]$^{neg}$ [JAK2]$^{neg}$ [TCR]$^{neg}$[TIGIT]$^{neg}$ [JAK2]$^{neg}$ [β2m]$^{neg}$[PD1]$^{neg}$ [JAK2]$^{neg}$ [β2m]$^{neg}$[CTLA4]$^{neg}$ [JAK2]$^{neg}$ [β2m]$^{neg}$[TIM-3]$^{neg}$ [JAK2]$^{neg}$ [β2m]$^{neg}$[LAG3]$^{neg}$ [JAK2]$^{neg}$ [β2m]$^{neg}$[TIGIT]$^{neg}$ [JAK2]$^{neg}$ [HLA]$^{neg}$[PD1]$^{neg}$ | [JAK2]$^{neg}$ [TCR]$^{neg}$[DCK]$^{neg}$ [JAK2]$^{neg}$ [TCR]$^{neg}$[HPRT]$^{neg}$ [JAK2]$^{neg}$ [β2m]$^{neg}$[DCK]$^{neg}$ [JAK2]$^{neg}$ [β2m]$^{neg}$[HPRT]$^{neg}$ [JAK2]$^{neg}$ [HLA]$^{neg}$[DCK]$^{neg}$ [JAK2]$^{neg}$ [HLA]$^{neg}$[HPRT]$^{neg}$ [JAK2]$^{neg}$ [DCK]$^{neg}$[PD1]$^{neg}$ [JAK2]$^{neg}$ [DCK]$^{neg}$[CTLA4]$^{neg}$ [JAK2]$^{neg}$ [DCK]$^{neg}$[TIM-3]$^{neg}$ [JAK2]$^{neg}$ [DCK]$^{neg}$[LAG3]$^{neg}$ [JAK2]$^{neg}$ [DCK]$^{neg}$[TIGIT]$^{neg}$ | [JAK2]$^{neg}$ [TCR]$^{neg}$[GR]$^{neg}$ [JAK2]$^{neg}$ [TCR]$^{neg}$[CD52]$^{neg}$ [JAK2]$^{neg}$ [β2m]$^{neg}$[GR]$^{neg}$ [JAK2]$^{neg}$ [β2m]$^{neg}$[CD52]$^{neg}$ [JAK2]$^{neg}$ [HLA]$^{neg}$[GR]$^{neg}$ [JAK2]$^{neg}$ [HLA]$^{neg}$[CD52]$^{neg}$ [JAK2]$^{neg}$ [GR]$^{neg}$[PD1]$^{neg}$ [JAK2]$^{neg}$ [GR]$^{neg}$[CTLA4]$^{neg}$ [JAK2]$^{neg}$ [GR]$^{neg}$[TIM-3]$^{neg}$ [JAK2]$^{neg}$ [GR]$^{neg}$[LAG3]$^{neg}$ [JAK2]$^{neg}$ [GR]$^{neg}$[TIGIT]$^{neg}$ |

TABLE 1-continued

Preferred target genes for the production of engineered immune cells with enhanced immune functions according to the present invention:

Genotype of preferred engineered Immune cells

| Primary target genes | Phenotype | Additional KO to lower alloreactivity: [TCR]$^{neg}$ [β2m]$^{neg}$ | Additional KO to inactivate checkpoint inhibitors: [PD1]$^{neg}$ [CTLA4]$^{neg}$ [TIM-3]$^{neg}$ [LAG3]$^{neg}$ [TIGIT]$^{neg}$ | Additional KO to confer resistance to drugs: Purine analogue drugs: [DCK]$^{neg}$ 6 mercaptopurine (6 MP) and 6 thioguanine (6 TG) [HPRT]$^{neg}$ | Resistance to immunodepletion agents: glucocorticoids receptors: [GR]$^{neg}$ Alemtuzumab receptor [CD52]$^{neg}$ |
|---|---|---|---|---|---|
| Single KO | | | | [JAK2]$^{neg}$ [HPRT]$^{neg}$[PD1]$^{neg}$ | [JAK2]$^{neg}$ [CD52]$^{neg}$[PD1]$^{neg}$ |
| | | | | [JAK2]$^{neg}$ [HPRT]$^{neg}$[CTLA4]$^{neg}$ | [JAK2]$^{neg}$ |
| | | | | [JAK2]$^{neg}$ [HPRT]$^{neg}$[TIM-3]$^{neg}$ | [CD52]$^{neg}$[CTLA4]$^{neg}$ |
| | | | | [JAK2]$^{neg}$ [HPRT]$^{neg}$[LAG3]$^{neg}$ | [JAK2]$^{neg}$ [CD52]$^{neg}$[TIM-3]$^{neg}$ |
| | | | | [JAK2]$^{neg}$ [HPRT]$^{neg}$[TIGIT]$^{neg}$ | [JAK2]$^{neg}$ [CD52]$^{neg}$[LAG3]$^{neg}$ |
| | | | | | [JAK2]$^{neg}$ [CD52]$^{neg}$[TIGIT]$^{neg}$ |
| [AURKA]$^{neg}$ Aliases: [AIK]$^{neg}$, [ARK1]$^{neg}$, [AURA]$^{neg}$, [BTAK]$^{neg}$, [PPP1R47]$^{neg}$, [STK15]$^{neg}$, [STK6]$^{neg}$, [STK7]$^{neg}$ | Reduced alloreactivity | [AURKA]$^{neg}$ [TCR]$^{neg}$ [AURKA]$^{neg}$[β2m]$^{neg}$ [AURKA]$^{neg}$[HLA]$^{neg}$ [AURKA]$^{neg}$ [TCR]$^{neg}$[β2m]$^{neg}$ [AURKA]$^{neg}$ [TCR]$^{neg}$[HLA]$^{neg}$ | [AURKA]$^{neg}$ [TCR]$^{neg}$[PD1]$^{neg}$ [AURKA]$^{neg}$ [TCR]$^{neg}$[CTLA4]$^{neg}$ [TCR]$^{neg}$[CTLA4]$^{neg}$ [AURKA]$^{neg}$ [TCR]$^{neg}$[TIM-3]$^{neg}$ [AURKA]$^{neg}$ [TCR]$^{neg}$[LAG3]$^{neg}$ [AURKA]$^{neg}$ [TCR]$^{neg}$[TIGIT]$^{neg}$ [AURKA]$^{neg}$ [β2m]$^{neg}$[PD1]$^{neg}$ [β2m]$^{neg}$[CTLA4]$^{neg}$ [AURKA]$^{neg}$ [β2m]$^{neg}$[TIM-3]$^{neg}$ [AURKA]$^{neg}$ [β2m]$^{neg}$[LAG3]$^{neg}$ [β2m]$^{neg}$[TIGIT]$^{neg}$ [AURKA]$^{neg}$ [HLA]$^{neg}$[PD1]$^{neg}$ [AURKA]$^{neg}$ [HLA]$^{neg}$[CTLA4]$^{neg}$ [AURKA]$^{neg}$ [HLA]$^{neg}$[TIM-3]$^{neg}$ [HLA]$^{neg}$[LAG3]$^{neg}$ [AURKA]$^{neg}$ [HLA]$^{neg}$[TIGIT]$^{neg}$ | [AURKA]$^{neg}$ [TCR]$^{neg}$[DCK]$^{neg}$ [AURKA]$^{neg}$ [TCR]$^{neg}$[HPRT]$^{neg}$ [AURKA]$^{neg}$ [β2m]$^{neg}$[DCK]$^{neg}$ [AURKA]$^{neg}$ [β2m]$^{neg}$[HPRT]$^{neg}$ [AURKA]$^{neg}$ [HLA]$^{neg}$[DCK]$^{neg}$ [AURKA]$^{neg}$ [HLA]$^{neg}$[HPRT]$^{neg}$ [AURKA]$^{neg}$ [DCK]$^{neg}$[PD1]$^{neg}$ [AURKA]$^{neg}$ [DCK]$^{neg}$[CTLA4]$^{neg}$ [AURKA]$^{neg}$ [DCK]$^{neg}$[TIM-3]$^{neg}$ [AURKA]$^{neg}$ [DCK]$^{neg}$[LAG3]$^{neg}$ [AURKA]$^{neg}$ [DCK]$^{neg}$[TIGIT]$^{neg}$ [AURKA]$^{neg}$ [HPRT]$^{neg}$[PD1]$^{neg}$ [HPRT]$^{neg}$[CTLA4]$^{neg}$ [AURKA]$^{neg}$ [HPRT]$^{neg}$[TIM-3]$^{neg}$ [AURKA]$^{neg}$ [HPRT]$^{neg}$[LAG3]$^{neg}$ [AURKA]$^{neg}$ [HPRT]$^{neg}$[TIGIT]$^{neg}$ | [AURKA]$^{neg}$ [TCR]$^{neg}$[GR]$^{neg}$ [AURKA]$^{neg}$ [TCR]$^{neg}$[CD52]$^{neg}$ [AURKA]$^{neg}$ [β2m]$^{neg}$[GR]$^{neg}$ [AURKA]$^{neg}$ [β2m]$^{neg}$[CD52]$^{neg}$ [AURKA]$^{neg}$ [HLA]$^{neg}$[GR]$^{neg}$ [AURKA]$^{neg}$ [HLA]$^{neg}$[CD52]$^{neg}$ [AURKA]$^{neg}$ [GR]$^{neg}$[PD1]$^{neg}$ [AURKA]$^{neg}$ [GR]$^{neg}$[CTLA4]$^{neg}$ [AURKA]$^{neg}$ [GR]$^{neg}$[TIM-3]$^{neg}$ [AURKA]$^{neg}$ [GR]$^{neg}$[LAG3]$^{neg}$ [AURKA]$^{neg}$ [GR]$^{neg}$[TIGIT]$^{neg}$ [AURKA]$^{neg}$ [CD52]$^{neg}$[PD1]$^{neg}$ [CD52]$^{neg}$[CTLA4]$^{neg}$ [AURKA]$^{neg}$ [CD52]$^{neg}$[TIM-3]$^{neg}$ [AURKA]$^{neg}$ [CD52]$^{neg}$[LAG3]$^{neg}$ [AURKA]$^{neg}$ [CD52]$^{neg}$[TIGIT]$^{neg}$ |
| [DNMT3A]$^{neg}$ Aliases: [DNMT3A2]$^{neg}$, [M.HsaIIIA]$^{neg}$, [TBRS]$^{neg}$ | Reduced T-cell exhaustion | [DNMT3A]$^{neg}$ [TCR]$^{neg}$ [DNMT3A]$^{neg}$[β2m]$^{neg}$ [DNMT3A]$^{neg}$[HLA]$^{neg}$ [DNMT3A]$^{neg}$ [TCR]$^{neg}$[β2m]$^{neg}$ [DNMT3A]$^{neg}$ [TCR]$^{neg}$[HLA]$^{neg}$ | [DNMT3A]$^{neg}$ [TCR]$^{neg}$[PD1]$^{neg}$ [DNMT3A]$^{neg}$[CTLA4]$^{neg}$ [DNMT3A]$^{neg}$ [TCR]$^{neg}$[TIM-3]$^{neg}$ [DNMT3A]$^{neg}$ [TCR]$^{neg}$[LAG3]$^{neg}$ [DNMT3A]$^{neg}$ [TCR]$^{neg}$[TIGIT]$^{neg}$ | [DNMT3A]$^{neg}$ [TCR]$^{neg}$[DCK]$^{neg}$ [DNMT3A]$^{neg}$ [TCR]$^{neg}$[HPRT]$^{neg}$ [DNMT3A]$^{neg}$ [β2m]$^{neg}$[DCK]$^{neg}$ [DNMT3A]$^{neg}$ [β2m]$^{neg}$[HPRT]$^{neg}$ [DNMT3A]$^{neg}$ [HLA]$^{neg}$[DCK]$^{neg}$ [DNMT3A]$^{neg}$ [HLA]$^{neg}$[HPRT]$^{neg}$ [DNMT3A]$^{neg}$ [DCK]$^{neg}$[PD1]$^{neg}$ [DCK]$^{neg}$[CTLA4]$^{neg}$ [DNMT3A]$^{neg}$ [DCK]$^{neg}$[TIM-3]$^{neg}$ | [DNMT3A]$^{neg}$ [TCR]$^{neg}$[GR]$^{neg}$ [DNMT3A]$^{neg}$ [TCR]$^{neg}$[CD52]$^{neg}$ [DNMT3A]$^{neg}$ [β2m]$^{neg}$[GR]$^{neg}$ [DNMT3A]$^{neg}$ [β2m]$^{neg}$[CD52]$^{neg}$ [DNMT3A]$^{neg}$ [HLA]$^{neg}$[GR]$^{neg}$ [DNMT3A]$^{neg}$ [HLA]$^{neg}$[CD52]$^{neg}$ [DNMT3A]$^{neg}$ [GR]$^{neg}$[PD1]$^{neg}$ |

TABLE 1-continued

Preferred target genes for the production of engineered immune cells with enhanced immune functions according to the present invention:

Genotype of preferred engineered Immune cells

| Primary target genes | Phenotype | Additional KO to lower alloreactivity: [TCR]$^{neg}$ [β2m]$^{neg}$ | Additional KO to inactivate checkpoint inhibitors: [PD1]$^{neg}$ [CTLA4]$^{neg}$ [TIM-3]$^{neg}$ [LAG3]$^{neg}$ [TIGIT]$^{neg}$ [HLA]$^{neg}$ | Additional KO to confer resistance to drugs: Purine analogue drugs: [DCK]$^{neg}$ 6 mercaptopurine (6 MP) and 6 thioguanine (6 TG) [HPRT]$^{neg}$ | Resistance to immunodepletion agents: glucocorticoids receptors: [GR]$^{neg}$ Alemtuzumab receptor [CD52]$^{neg}$ |
|---|---|---|---|---|---|
| Single KO [MT1A]$^{neg}$ Aliases: [MT1]$^{neg}$, [MT1S]$^{neg}$, [MTC]$^{neg}$ | Reduced T-cell exhaustion | [MT1A]$^{neg}$ [TCR]$^{neg}$ [MT1A]$^{neg}$ [β2m]$^{neg}$ [MT1A]$^{neg}$ [HLA]$^{neg}$ [MT1A]$^{neg}$ [TCR]$^{neg}$[β2m]$^{neg}$ [MT1A]$^{neg}$ [TCR]$^{neg}$[HLA]$^{neg}$ | [DNMT3A]$^{neg}$ [β2m]$^{neg}$[PD1]$^{neg}$ [DNMT3A]$^{neg}$ [β2m]neg[CTLA4]$^{neg}$ [DNMT3A]$^{neg}$ [β2m]$^{neg}$[TIM-3]$^{neg}$ [DNMT3A]$^{neg}$ [β2m]$^{neg}$[LAG3]$^{neg}$ [DNMT3A]$^{neg}$ [β2m]$^{neg}$[TIGIT]$^{neg}$ [DNMT3A]$^{neg}$ [HLA]$^{neg}$[PD1]$^{neg}$ [DNMT3A]$^{neg}$ [HLA]$^{neg}$[CTLA4]$^{neg}$ [DNMT3A]$^{neg}$ [HLA]$^{neg}$[TIM-3]$^{neg}$ [DNMT3A]$^{neg}$ [HLA]$^{neg}$[LAG3]$^{neg}$ [DNMT3A]$^{neg}$ [HLA]$^{neg}$[TIGIT]$^{neg}$ [MT1A]$^{neg}$ [TCR]$^{neg}$[PD1]$^{neg}$ [MT1A]$^{neg}$ [TCR]$^{neg}$[CTLA4]$^{neg}$ [MT1A]$^{neg}$ [TCR]$^{neg}$[TIM-3]$^{neg}$ [MT1A]$^{neg}$ [TCR]$^{neg}$[LAG3]$^{neg}$ [MT1A]$^{neg}$ [TCR]$^{neg}$[TIGIT]$^{neg}$ [MT1A]$^{neg}$ [β2m]$^{neg}$[PD1]$^{neg}$ [MT1A]$^{neg}$ [β2m]$^{neg}$[CTLA4]$^{neg}$ [MT1A]$^{neg}$ [β2m]$^{neg}$[TIM-3]$^{neg}$ [MT1A]$^{neg}$ [β2m]$^{neg}$[LAG3]$^{neg}$ [MT1A]$^{neg}$ [β2m]$^{neg}$[TIGIT]$^{neg}$ [MT1A]$^{neg}$ [HLA]$^{neg}$[PD1]$^{neg}$ [MT1A]$^{neg}$ [HLA]$^{neg}$[CTLA4]$^{neg}$ [MT1A]$^{neg}$ [HLA]$^{neg}$[TIM-3]$^{neg}$ [MT1A]$^{neg}$ [HLA]$^{neg}$[LAG3]$^{neg}$ [MT1A]$^{neg}$ [HLA]$^{neg}$[TIGIT]$^{neg}$ | [DNMT3A]$^{neg}$ [DCK]$^{neg}$[LAG3]$^{neg}$ [DNMT3A]$^{neg}$ [DCK]$^{neg}$[TIGIT]$^{neg}$ [DNMT3A]$^{neg}$ [HPRT]$^{neg}$[PD1]$^{neg}$ [DNMT3A]$^{neg}$ [HPRT]$^{neg}$[CTLA4]$^{neg}$ [DNMT3A]$^{neg}$ [HPRT]$^{neg}$[TIM-3]$^{neg}$ [HPRT]$^{neg}$[LAG3]$^{neg}$ [HPRT]$^{neg}$[TIGIT]$^{neg}$ [MT1A]$^{neg}$ [TCR][DCK]$^{neg}$ [MT1A]$^{neg}$ [TCR][HPRT]$^{neg}$ [MT1A]$^{neg}$ [β2m]$^{neg}$[DCK]$^{neg}$ [MT1A]$^{neg}$ [β2m]$^{neg}$[HPRT]$^{neg}$ [MT1A]$^{neg}$ [HLA]$^{neg}$[DCK]$^{neg}$ [MT1A]$^{neg}$ [HLA]$^{neg}$[HPRT]$^{neg}$ [MT1A]$^{neg}$ [DCK][PD1]$^{neg}$ [MT1A]$^{neg}$ [DCK]$^{neg}$[CTLA4]$^{neg}$ [MT1A]$^{neg}$ [DCK]$^{neg}$[TIM-3]$^{neg}$ [MT1A]$^{neg}$ [DCK]$^{neg}$[LAG3]$^{neg}$ [MT1A]$^{neg}$ [DCK][TIGIT]$^{neg}$ [MT1A]$^{neg}$ [HPRT]$^{neg}$[PD1]$^{neg}$ [MT1A]$^{neg}$ [HPRT]$^{neg}$[CTLA4]$^{neg}$ [MT1A]$^{neg}$ [HPRT]$^{neg}$[TIM-3]$^{neg}$ [MT1A]$^{neg}$ [HPRT]$^{neg}$[LAG3]$^{neg}$ [MT1A]$^{neg}$ [HPRT]$^{neg}$[TIGIT]$^{neg}$ | [DNMT3A]$^{neg}$ [GR]$^{neg}$[CTLA4]$^{neg}$ [DNMT3A]$^{neg}$ [GR]$^{neg}$[TIM-3]$^{neg}$ [DNMT3A]$^{neg}$ [GR]$^{neg}$[LAG3]$^{neg}$ [DNMT3A]$^{neg}$ [GR]$^{neg}$[TIGIT]$^{neg}$ [DNMT3A]$^{neg}$ [CD52]$^{neg}$[PD1]$^{neg}$ [DNMT3A]$^{neg}$ [CD52]$^{neg}$[CTLA4]$^{neg}$ [DNMT3A]$^{neg}$ [CD52]$^{neg}$[TIM-3]$^{neg}$ [DNMT3A]$^{neg}$ [CD52]$^{neg}$[LAG3]$^{neg}$ [DNMT3A]$^{neg}$ [CD52]$^{neg}$[TIGIT]$^{neg}$ [MT1A]$^{neg}$ [TCR][GR]$^{neg}$ [MT1A]$^{neg}$ [TCR]$^{neg}$[CD52]$^{neg}$ [MT1A]$^{neg}$ [β2m]$^{neg}$[GR]$^{neg}$ [MT1A]$^{neg}$ [β2m]$^{neg}$[CD52]$^{neg}$ [MT1A]$^{neg}$ [HLA]$^{neg}$[GR]$^{neg}$ [MT1A]$^{neg}$ [HLA]$^{neg}$[CD52]$^{neg}$ [MT1A]$^{neg}$ [GR]$^{neg}$[PD1]$^{neg}$ [MT1A]$^{neg}$ [GR]$^{neg}$[CTLA4]$^{neg}$ [MT1A]$^{neg}$ [GR]$^{neg}$[TIM-3]$^{neg}$ [MT1A]$^{neg}$ [GR]$^{neg}$[LAG3]$^{neg}$ [MT1A]$^{neg}$ [GR]$^{neg}$[TIGIT]$^{neg}$ [MT1A]$^{neg}$ [CD52]$^{neg}$[PD1]$^{neg}$ [CD52]$^{neg}$[CTLA4]$^{neg}$ [MT1A]$^{neg}$ [CD52]$^{neg}$[TIM-3]$^{neg}$ [MT1A]$^{neg}$ [CD52]$^{neg}$[LAG3]$^{neg}$ [MT1A]$^{neg}$ [CD52]$^{neg}$[TIGIT]$^{neg}$ |
| [MT2A]$^{neg}$ Aliases: [MT2]$^{neg}$ | Reduced T-cell exhaustion | [MT2A]$^{neg}$ [TCR]$^{neg}$ [MT2A]$^{neg}$ [β2m]$^{neg}$ [MT2A]$^{neg}$ [HLA]$^{neg}$ [TCR]$^{neg}$[β2m]$^{neg}$ [MT2A]$^{neg}$ [TCR]$^{neg}$[HLA]$^{neg}$ | [MT2A]$^{neg}$ [TCR]$^{neg}$[PD1]$^{neg}$ [MT2A]$^{neg}$ [TCR]$^{neg}$[CTLA4]$^{neg}$ [MT2A]$^{neg}$ [TCR]$^{neg}$[TIM-3]$^{neg}$ [MT2A]$^{neg}$ [TCR]$^{neg}$[LAG3]$^{neg}$ [MT2A]$^{neg}$ [TCR]$^{neg}$[TIGIT]$^{neg}$ [MT2A]$^{neg}$ [β2m]$^{neg}$[PD1]$^{neg}$ | [MT2A]$^{neg}$ [TCR][DCK]$^{neg}$ [MT2A]$^{neg}$ [TCR][HPRT]$^{neg}$ [MT2A]$^{neg}$ [β2m]$^{neg}$[DCK]$^{neg}$ [MT2A]$^{neg}$ [β2m]$^{neg}$[HPRT]$^{neg}$ [MT2A]$^{neg}$ [HLA]$^{neg}$[DCK]$^{neg}$ [MT2A]$^{neg}$ [HLA]$^{neg}$[HPRT]$^{neg}$ | [MT2A]$^{neg}$ [TCR][GR]$^{neg}$ [MT2A]$^{neg}$ [TCR]$^{neg}$[CD52]$^{neg}$ [MT2A]$^{neg}$ [β2m]$^{neg}$[GR]$^{neg}$ [MT2A]$^{neg}$ [β2m]$^{neg}$[CD52]$^{neg}$ [MT2A]$^{neg}$ [HLA]$^{neg}$[GR]$^{neg}$ [MT2A]$^{neg}$ [HLA]$^{neg}$[CD52]$^{neg}$ |

TABLE 1-continued

Preferred target genes for the production of engineered immune cells with enhanced immune functions according to the present invention:

Genotype of preferred engineered Immune cells

| Primary target genes | Phenotype | Additional KO to lower alloreactivity: [TCR]$^{neg}$ [β2m]$^{neg}$ | Additional KO to inactivate checkpoint inhibitors: [PD1]$^{neg}$ [CTLA4]$^{neg}$ [TIM-3]$^{neg}$ [LAG3]$^{neg}$ [TIGIT]$^{neg}$ [HLA]$^{neg}$ | Additional KO to confer resistance to drugs: Purine analogue drugs: [DCK]$^{neg}$ 6 mercaptopurine (6 MP) and 6 thioguanine (6 TG): [HPRT]$^{neg}$ | Resistance to immunodepletion agents: glucocorticoids receptors: [GR]$^{neg}$ Alemtuzumab receptor [CD52]$^{neg}$ |
|---|---|---|---|---|---|
| [PTGER2]$^{neg}$ Aliases: [EP2]$^{neg}$ | Single KO | | | | |
| | | | | [MT2A]$^{neg}$[DCK]$^{neg}$[PD1]$^{neg}$ | [MT2A]$^{neg}$ [GR]$^{neg}$[PD1]$^{neg}$ |
| | | | [MT2A]$^{neg}$ [β2m]$^{neg}$[CTLA4]$^{neg}$ | [MT2A]$^{neg}$[DCK]$^{neg}$[CTLA4]$^{neg}$ | [MT2A]$^{neg}$ [GR]$^{neg}$[CTLA4]$^{neg}$ |
| | | | [MT2A]$^{neg}$ [β2m]$^{neg}$[TIM-3]$^{neg}$ | [MT2A]$^{neg}$[DCK]$^{neg}$[TIM-3]$^{neg}$ | [MT2A]$^{neg}$ [GR]$^{neg}$[TIM-3]$^{neg}$ |
| | | | [MT2A]$^{neg}$ [β2m]$^{neg}$[LAG3]$^{neg}$ | [MT2A]$^{neg}$[DCK]$^{neg}$[LAG3]$^{neg}$ | [MT2A]$^{neg}$ [GR]$^{neg}$[LAG3]$^{neg}$ |
| | | | [MT2A]$^{neg}$ [β2m]$^{neg}$[TIGIT]$^{neg}$ | [MT2A]$^{neg}$[DCK]$^{neg}$[TIGIT]$^{neg}$ | [MT2A]$^{neg}$ [GR]$^{neg}$[TIGIT]$^{neg}$ |
| | | | [MT2A]$^{neg}$ [HLA]$^{neg}$[PD1]$^{neg}$ | [MT2A]$^{neg}$[HPRT]$^{neg}$[PD1]$^{neg}$ | [MT2A]$^{neg}$ [CD52]$^{neg}$[PD1]$^{neg}$ |
| | | | [MT2A]$^{neg}$ | [MT2A]$^{neg}$ | [MT2A]$^{neg}$ |
| | | | [HLA]$^{neg}$[CTLA4]$^{neg}$ | [HPRT]$^{neg}$[CTLA4]$^{neg}$ | [CD52]$^{neg}$[CTLA4]$^{neg}$ |
| | | | [MT2A]$^{neg}$ [HLA]$^{neg}$[TIM-3]$^{neg}$ | [MT2A]$^{neg}$[HPRT]$^{neg}$[TIM-3]$^{neg}$ | [MT2A]$^{neg}$ [CD52]$^{neg}$[TIM-3]$^{neg}$ |
| | | | [MT2A]$^{neg}$ [HLA]$^{neg}$[LAG3]$^{neg}$ | [MT2A]$^{neg}$[HPRT]$^{neg}$[LAG3]$^{neg}$ | [MT2A]$^{neg}$ [CD52]$^{neg}$[LAG3]$^{neg}$ |
| | | | [MT2A]$^{neg}$ [HLA]$^{neg}$[TIGIT]$^{neg}$ | [MT2A]$^{neg}$[HPRT]$^{neg}$[TIGIT]$^{neg}$ | [MT2A]$^{neg}$ [CD52]$^{neg}$[TIGIT]$^{neg}$ |
| | Reduced T-cell exhaustion | [PTGER2]$^{neg}$ [TCR]$^{neg}$ [PTGER2]$^{neg}$[β2m]$^{neg}$ [PTGER2]$^{neg}$[HLA]$^{neg}$ [PTGER2]$^{neg}$ [TCR]$^{neg}$[β2m]$^{neg}$ [PTGER2]$^{neg}$ [TCR]$^{neg}$[HLA]$^{neg}$ | [PTGER2]$^{neg}$ [TCR]$^{neg}$[PD1]$^{neg}$ [PTGER2]$^{neg}$ [TCR]$^{neg}$[CTLA4]$^{neg}$ [PTGER2]$^{neg}$ [TCR]$^{neg}$[TIM-3]$^{neg}$ [PTGER2]$^{neg}$ [TCR]$^{neg}$[LAG3]$^{neg}$ [TCR]$^{neg}$[TIGIT]$^{neg}$ [PTGER2]$^{neg}$ [β2m]$^{neg}$[PD1]$^{neg}$ [PTGER2]$^{neg}$[CTLA4]$^{neg}$ [β2m]$^{neg}$[CTLA4]$^{neg}$ [PTGER2]$^{neg}$ [β2m]$^{neg}$[TIM-3]$^{neg}$ [PTGER2]$^{neg}$ [β2m]$^{neg}$[TIGIT]$^{neg}$ [PTGER2]$^{neg}$[LAG3]$^{neg}$ [PTGER2]$^{neg}$ [HLA]$^{neg}$[PD1]$^{neg}$ [PTGER2]$^{neg}$ [HLA]$^{neg}$[TIM-3]$^{neg}$ [PTGER2]$^{neg}$[CTLA4]$^{neg}$ [PTGER2]$^{neg}$[TIGIT]$^{neg}$ [HLA]$^{neg}$[LAG3]$^{neg}$ [PTGER2]$^{neg}$ [HLA]$^{neg}$[TIGIT]$^{neg}$ | [PTGER2]$^{neg}$ [TCR]$^{neg}$[DCK]$^{neg}$ [PTGER2]$^{neg}$ [TCR]$^{neg}$[HPRT]$^{neg}$ [PTGER2]$^{neg}$ [β2m]$^{neg}$[DCK]$^{neg}$ [PTGER2]$^{neg}$ [β2m]$^{neg}$[HPRT]$^{neg}$ [PTGER2]$^{neg}$ [HLA]$^{neg}$[DCK]$^{neg}$ [PTGER2]$^{neg}$ [HLA]$^{neg}$[HPRT]$^{neg}$ [PTGER2]$^{neg}$ [DCK]$^{neg}$[PD1]$^{neg}$ [PTGER2]$^{neg}$ [DCK]$^{neg}$[CTLA4]$^{neg}$ [PTGER2]$^{neg}$ [DCK]$^{neg}$[TIM-3]$^{neg}$ [PTGER2]$^{neg}$ [DCK]$^{neg}$[LAG3]$^{neg}$ [PTGER2]$^{neg}$ [DCK]$^{neg}$[TIGIT]$^{neg}$ [PTGER2]$^{neg}$ [HPRT]$^{neg}$[PD1]$^{neg}$ [HPRT]$^{neg}$[CTLA4]$^{neg}$ [PTGER2]$^{neg}$ [HPRT]$^{neg}$[TIM-3]$^{neg}$ [PTGER2]$^{neg}$ [HPRT]$^{neg}$[LAG3]$^{neg}$ [PTGER2]$^{neg}$ [HPRT]$^{neg}$[TIGIT]$^{neg}$ | [PTGER2]$^{neg}$ [TCR]$^{neg}$[GR]$^{neg}$ [PTGER2]$^{neg}$ [TCR]$^{neg}$[CD52]$^{neg}$ [PTGER2]$^{neg}$ [β2m]$^{neg}$[GR]$^{neg}$ [PTGER2]$^{neg}$ [β2m]$^{neg}$[CD52]$^{neg}$ [PTGER2]$^{neg}$ [HLA]$^{neg}$[GR]$^{neg}$ [HLA]$^{neg}$[CD52]$^{neg}$ [PTGER2]$^{neg}$ [GR]$^{neg}$[PD1]$^{neg}$ [PTGER2]$^{neg}$ [GR]$^{neg}$[CTLA4]$^{neg}$ [PTGER2]$^{neg}$ [GR]$^{neg}$[TIM-3]$^{neg}$ [PTGER2]$^{neg}$ [GR]$^{neg}$[LAG3]$^{neg}$ [PTGER2]$^{neg}$ [GR]$^{neg}$[TIGIT]$^{neg}$ [CD52]$^{neg}$[CTLA4]$^{neg}$ [PTGER2]$^{neg}$ [CD52]$^{neg}$[TIM-3]$^{neg}$ [PTGER2]$^{neg}$ [CD52]$^{neg}$[LAG3]$^{neg}$ [PTGER2]$^{neg}$ [CD52]$^{neg}$[TIGIT]$^{neg}$ |

DETAILED DESCRIPTION OF THE INVENTION

Unless specifically defined herein, all technical and scientific terms used herein have the same meaning as commonly understood by a skilled artisan in the fields of gene therapy, biochemistry, genetics, and molecular biology.

All methods and materials similar or equivalent to those described herein can be used in the practice or testing of the present invention, with suitable methods and materials being described herein. All publications, patent applications, patents, and other references mentioned herein are incorporated by reference in their entirety. In case of conflict, the present specification, including definitions, will prevail. Further, the materials, methods, and examples are illustrative only and are not intended to be limiting, unless otherwise specified.

The practice of the present invention will employ, unless otherwise indicated, conventional techniques of cell biology, cell culture, molecular biology, transgenic biology, microbiology, recombinant DNA, and immunology, which are within the skill of the art. Such techniques are explained fully in the literature. See, for example, Current Protocols in Molecular Biology (Frederick M. AUSUBEL, 2000, Wiley and son Inc, Library of Congress, USA); Molecular Cloning: A Laboratory Manual, Third Edition, (Sambrook et al, 2001, Cold Spring Harbor, New York: Cold Spring Harbor Laboratory Press); Oligonucleotide Synthesis (M. J. Gait ed., 1984); Mullis et al. U.S. Pat. No. 4,683,195; Nucleic Acid Hybridization (B. D. Harries & S. J. Higgins eds. 1984); Transcription And Translation (B. D. Hames & S. J. Higgins eds. 1984); Culture Of Animal Cells (R. I. Freshney, Alan R. Liss, Inc., 1987); Immobilized Cells And Enzymes (IRL Press, 1986); B. Perbal, A Practical Guide To Molecular Cloning (1984); the series, Methods In ENZYMOLOGY (J. Abelson and M. Simon, eds.-in-chief, Academic Press, Inc., New York), specifically, Vols. 154 and 155 (Wu et al. eds.) and Vol. 185, "Gene Expression Technology" (D. Goeddel, ed.); Gene Transfer Vectors For Mammalian Cells (J. H. Miller and M. P. Calos eds., 1987, Cold Spring Harbor Laboratory); Immunochemical Methods In Cell And Molecular Biology (Mayer and Walker, eds., Academic Press, London, 1987); Handbook Of Experimental Immunology, Volumes I-IV (D. M. Weir and C. C. Blackwell, eds., 1986); and Manipulating the Mouse Embryo, (Cold Spring Harbor Laboratory Press, Cold Spring Harbor, N.Y., 1986).

The present invention is drawn to a general method of preparing immune cells, preferably primary cells for immunotherapy by inactivating or reducing the expression of specified genes by using endonuclease reagents.

Gene editing techniques using polynucleotide sequence-specific reagents, such as rare-cutting endonucleases, have become the state of the art for the introduction of genetic modifications, especially into immune primary cells.

By "sequence-specific reagent" is meant any active molecule that has the ability to specifically recognize a selected polynucleotide sequence at a genomic locus, preferably of at least 9 bp, more preferably of at least 10 bp and even more preferably of at least 12 pb in length, in view of modifying said genomic locus. According to a preferred aspect of the invention, said sequence-specific reagent is preferably a sequence-specific nuclease reagent.

By "immune cell" is meant a cell of hematopoietic origin functionally involved in the initiation and/or execution of innate and/or adaptative immune response, such as typically CD3 or CD4 positive cells. The immune cell according to the present invention can be a dendritic cell, killer dendritic cell, a mast cell, a NK-cell, a B-cell or a T-cell selected from the group consisting of inflammatory T-lymphocytes, cytotoxic T-lymphocytes, regulatory T-lymphocytes or helper T-lymphocytes. Cells can be obtained from a number of non-limiting sources, including peripheral blood mononuclear cells, bone marrow, lymph node tissue, cord blood, thymus tissue, tissue from a site of infection, ascites, pleural effusion, spleen tissue, and from tumors, such as tumor infiltrating lymphocytes. In some embodiments, said immune cell can be derived from a healthy donor, from a patient diagnosed with cancer or from a patient diagnosed with an infection. In another embodiment, said cell is part of a mixed population of immune cells which present different phenotypic characteristics, such as comprising CD4, CD8 and CD56 positive cells.

By "primary cell" or "primary cells" are intended cells taken directly from living tissue (e.g. biopsy material) and established for growth in vitro for a limited amount of time, meaning that they can undergo a limited number of population doublings. Primary cells are opposed to continuous tumorigenic or artificially immortalized cell lines. Non-limiting examples of such cell lines are CHO-K1 cells; HEK293 cells; Caco2 cells; U2-OS cells; NIH 3T3 cells; NSO cells; SP2 cells; CHO-S cells; DG44 cells; K-562 cells, U-937 cells; MRC5 cells; IMR90 cells; Jurkat cells; HepG2 cells; HeLa cells; HT-1080 cells; HCT-116 cells; Hu-h7 cells; Huvec cells; Molt 4 cells. Primary cells are generally used in cell therapy as they are deemed more functional and less tumorigenic.

In general, primary immune cells are provided from donors or patients through a variety of methods known in the art, as for instance by leukapheresis techniques as reviewed by Schwartz J. et al. (Guidelines on the use of therapeutic apheresis in clinical practice-evidence-based approach from the Writing Committee of the American Society for Apheresis: the sixth special issue (2013) *J Clin Apher.* 28(3):145-284).

The primary immune cells according to the present invention can also be differentiated from stem cells, such as cord blood stem cells, progenitor cells, bone marrow stem cells, hematopoietic stem cells (HSC) and induced pluripotent stem cells (iPS).

By "nuclease reagent" is meant a nucleic acid molecule that contributes to an nuclease catalytic reaction in the target cell, preferably an endonuclease reaction, by itself or as a subunit of a complex such as a guide RNA/Cas9, preferably leading to the cleavage of a nucleic acid sequence target.

The nuclease reagents of the invention are generally "sequence-specific reagents", meaning that they can induce DNA cleavage in the cells at predetermined loci, referred to by extension as "targeted gene". The nucleic acid sequence which is recognized by the sequence specific reagents is referred to as "target sequence". Said target sequence is usually selected to be rare or unique in the cell's genome, and more extensively in the human genome, as can be determined using software and data available from human genome databases, such as ensembl.org "Rare-cutting endonucleases" are sequence-specific endonuclease reagents of choice, insofar as their recognition sequences generally range from 10 to 50 successive base pairs, preferably from 12 to 30 bp, and more preferably from 14 to 20 bp.

According to a preferred aspect of the invention, said endonuclease reagent is a nucleic acid encoding an "engineered" or "programmable" rare-cutting endonuclease, such as a homing endonuclease as described for instance by Arnould S., et al. (WO2004067736), a zing finger nuclease (ZFN) as described, for instance, by Urnov F., et al. (Highly efficient endogenous human gene correction using designed zinc-finger nucleases (2005) *Nature* 435:646-651), a TALE-Nuclease as described, for instance, by Mussolino et al. (A novel TALE nuclease scaffold enables high genome editing activity in combination with low toxicity (2011) *Nucl. Acids Res.* 39(21):9283-9293), or a MegaTAL nuclease as described, for instance by Boissel et al. (MegaTALs: a rare-cleaving nuclease architecture for therapeutic genome engineering (2013) Nucleic Acids Research 42 (4):2591-2601).

According to another embodiment, the endonuclease reagent is a RNA-guide to be used in conjunction with a RNA guided endonuclease, such as Cas9 or Cpf1, as per, inter alia, the teaching by Doudna, J., and Chapentier, E., (The new frontier of genome engineering with CRISPR-Cas9 (2014) *Science* 346 (6213):1077), which is incorporated herein by reference.

According to a preferred aspect of the invention, the endonuclease reagent is transiently expressed into the cells, meaning that said reagent is not supposed to integrate into the genome or persist over a long period of time, such as be the case of RNA, more particularly mRNA, proteins or complexes mixing proteins and nucleic acids (eg: Ribonucleoproteins).

In general, 80% the endonuclease reagent is degraded by 30 hours, preferably by 24, more preferably by 20 hours after transfection.

An endonuclease under mRNA form is preferably synthetized with a cap to enhance its stability according to techniques well known in the art, as described, for instance, by Kore A. L., et al. (Locked nucleic acid (LNA)-modified dinucleotide mRNA cap analogue: synthesis, enzymatic incorporation, and utilization (2009) *J Am Chem Soc.* 131 (18):6364-5).

In general, electroporation steps that are used to transfect immune cells are typically performed in closed chambers comprising parallel plate electrodes producing a pulse electric field between said parallel plate electrodes greater than 100 volts/cm and less than 5,000 volts/cm, substantially uniform throughout the treatment volume such as described in WO/2004/083379, which is incorporated by reference, especially from page 23, line 25 to page 29, line 11. One such electroporation chamber preferably has a geometric factor ($cm^{-1}$) defined by the quotient of the electrode gap squared (cm2) divided by the chamber volume ($cm^3$), wherein the geometric factor is less than or equal to 0.1 $cm^{-1}$, wherein the suspension of the cells and the sequence-specific reagent is in a medium which is adjusted such that the medium has conductivity in a range spanning 0.01 to 1.0 milliSiemens. In general, the suspension of cells undergoes one or more pulsed electric fields. With the method, the treatment volume of the suspension is scalable, and the time of treatment of the cells in the chamber is substantially uniform.

Due to their higher specificity, TALE-nuclease have proven to be particularly appropriate sequence specific nuclease reagents for therapeutic applications, especially under heterodimeric forms—i.e. working by pairs with a "left" monomer (also referred to as "5'" or "forward") and "right" monomer (also referred to as "3'"" or "reverse") as reported for instance by Mussolino et al. (TALEN©facilitate targeted genome editing in human cells with high specificity and low cytotoxicity (2014) *Nucl. Acids Res.* 42(10): 6762-6773).

As previously stated, the sequence specific reagent is preferably under the form of nucleic acids, such as under DNA or RNA form encoding a rare cutting endonuclease a subunit thereof, but they can also be part of conjugates involving polynucleotide(s) and polypeptide(s) such as so-called "ribonucleoproteins". Such conjugates can be formed with reagents as Cas9 or Cpf1 (RNA-guided endonucleases) or Argonaute (DNA-guided endonucleases) as recently respectively described by Zetsche, B. et al. (Cpf1 Is a Single RNA-Guided Endonuclease of a Class 2 CRISPR-Cas System (2015) *Cell* 163(3): 759-771) and by Gao F. et al. (DNA-guided genome editing using the Natronobacterium gregoryi Argonaute (2016) Nature Biotech), which involve RNA or DNA guides that can be complexed with their respective nucleases.

The applicant has formerly made available robust protocols and gene editing strategies to produce allogeneic therapeutic grade T-cells from PBMCs, especially by providing very safe and specific endonuclease reagents under the form of TALE-nucleases (TALEN©). The production of so-called "universal T-cells", which are $[TCR]^{neg}$ T-cells from donors was achieved and successfully injected to patients with limited reduced Graft versus Host Disease (GVhD) [Poirot et al. (2015) Multiplex Genome-Edited T-cell Manufacturing Platform for "Off-the-Shelf" Adoptive T-cell Immunotherapies. *Cancer. Res.* 75 (18): 3853-3864] [Qasim, W. et al. (2017) Molecular remission of infant B-ALL after infusion of universal TALEN gene-edited CAR T cells. *Science Translational* 9(374)]. Meanwhile, inactivation of TCR or β2m components in primary T-cells could be combined with the inactivation of further genes encoding checkpoint inhibitor proteins, such as described for instance in WO2014184744.

By "allogeneic" is meant that the cells originate from a donor, is produced or differentiated from stem cells in view of being infused into patients having a different haplotype.

The present invention provides with an efficient method for obtaining primary immune cells, which can be gene edited in various gene loci more particularly involved into host-graft interaction and recognition. Other loci may also be edited in view of improving the activity, the survival or the life-time of the engineered primary cells, especially primary T cells.

FIG. 1 maps the main cell functions that can be modified by gene editing according to the present invention to improve the efficiency of the engineered immune cells. Any gene inactivation listed under each function can be combined with another to obtain a synergistic effect on the overall therapeutic potency of the immune cells.

Different strategies of gene repression or inactivation are presented herein in the framework of the present invention. For sake of demonstration, these strategies can be independently performed but may also be combined with each other to produce engineered immune cells, precursors or progenitors thereof, which can be optimized for their various therapeutic uses.

Standard assays to assess the viability, functionality (cytotoxicity, degranulation tests . . . ) and antitumor (Engraftment assays of allogeneic cells into NOG (NOD/Shi-scid/IL-2Rγnull) mice developing human tumors) of the engineered cells are described in the art and reference can be made, for instance, to Rosa S. C., et al. [Sensitive and viable identification of antigen-specific CD8+ T cells by a flow cytometric assay for degranulation (2003) *J Immunol Methods.* 281:65-78] and to Menger L. et al. [TALEN-mediated genetic inactivation of the glucocorticoid receptor in cytomegalovirus-specific T-cells (2015) *Blood.* 126:2781-2789].

It shall be understood that when reference is made to a gene sequence expressing a protein in this application, this encompasses variants of the gene sequence which may encode functional homologues of the protein referenced into the databases, such as Uniprot (uniprot. org), which have at least 80% amino acid identity.

Targeting microRNA with Rare-Cutting Endonucleases into Hematopoietic Cells

The inventors have established that miRNAs influence immune cells function. Thus, one aspect of the present invention is to modify at least one sequence encoding miRNAs into an immune cell, preferably by using a sequence specific endonuclease reagent, such as a rare-cutting endonuclease to modulate or inactivate immune cells function.

A microRNA (abbreviated miRNA) is a small non-coding RNA molecule containing between 15 and 30, preferably 20 and 25 nucleotides that functions in RNA silencing and post-transcriptional regulation of gene expression [Ambros, V. (2004). "The functions of animal microRNAs". Nature. 431 (7006): 350-5]. While the majority of miRNAs are located within the cell, some miRNAs, commonly known as circulating miRNAs or extracellular miRNAs, can also be found in extracellular environment, including various biological fluids and cell culture media. miRNAs are encoded by eukaryotic nuclear DNA and function via base-pairing with complementary sequences within mRNA molecules. As a result, these mRNA molecules are silenced, by one or more of the following processes:

Cleavage of the mRNA strand into two pieces,
Destabilization of the mRNA through shortening of its poly(A) tail, and
Less efficient translation of the mRNA into proteins by ribosomes.

miRNAs derive from regions of RNA transcripts that fold back on themselves to form short hairpins. The human genome may encode over 1000 miRNAs, which are abundant in many mammalian cell types.

The method of the present invention more particularly involves a step of modifying miR21 (NCBI Gene ID: 406991), mir26A (NCBI Gene ID: 612151), miR31 (NCBI Gene ID: 407035) and/or miR101 (NCBI Gene ID: 612511 or 612512), preferably both miR26A and miR101, both miR21 and miR26A or both miR21 and MiR101.

Targeting Genes Involved into Reduction of Glycolysis and Calcium Signaling in Response to Low Glucose Conditions.

One aspect of the present invention is to genetically engineer immune cells by reducing or inactivating the expression of genes that downregulate glycolysis and calcium metabolism, and more especially genes involved into glycolysis and calcium signaling pathways, such as SERCA3 (Uniprot:P16615), EZH2 (Uniprot:Q15910) and BCAT (Uniprot:P54687).

It has been shown that glucose deprivation leads, in T cells, to a reduced level of phosphoenolpyruvate (PEP) a glycolytic metabolite, resulting to a defect in Ca2+-NFAT signaling due to altered Ca2+ flux (Ho et al. (2015) Phosphoenolpyruvate Is a Metabolic Checkpoint of Anti-tumor T Cell Responses. Cell. 162(6):1217-28). It has been shown that PEP regulates Ca2+ flux by inactivating SERCA mediated Ca2+ transport into the endoplasmic reticulum.

Without being bound by the theory, it is believed that increasing level of PEP or decreasing level of SERCA leads to T-cells with improved anti-tumor response.

It is also assumed that, in T-cells, glucose deprivation reduces the expression of Enhancer Zest Homolog 2 (EZH2) which regulates effector T cell polyfunctionality and survival. EZH2 is a catalytic subunit of polycolomb-group family members with histone methytransferase activity of trimethylating histone H3 on lysine 27 that activates the Notch pathway by transcriptional repression of Notch repressors. While, EZH2 downregulation by glucose deprivation is mediated by mRNA26a and miRNA101 [Zhao et al. (2016) Cancer mediates effector T cell dysfunction by targeting microRNAs and EZH2 via glycolysis restriction. Nat. Immunol. 17(1):95-103], the inventors have found that inducing EZH2 (over)-expression and/or inactivating miRNA26a or miRNA101 can enhance the survival of immune cells in low glucose environment.

The cytosolic branched chain aminotransferase (BCAT) is an amino acid catabolic enzyme that regulates the level of branched chain amino acids which are necessary for protein synthesis. In addition to its role in amino acid synthesis pathway, BCAT has been shown to be involved in metabolic reprogramming. Indeed, BCAT inactivation in mouse activated T cells results in higher rates of glycolysis, glycolytic capacity and glycolytic reserve compared to wild type (Ananieva et al. (2014) Cytosolic Branched Chain Aminotransferase (BCATc) Regulates mTORC1 Signaling and Glycolytic Metabolism in CD4+ T Cells. *J. Biol. Chem.* 289(27):18793-804]. The inventors have found that inactivating this gene in T-cells could improve T cell function in low glucose tumor microenvironment. Without being bound by the theory, BCAT is believed to mobilize T-cells glycolytic reserves.

The present invention is thus directed toward engineered primary immune cells, progenitor or precursor cells thereof, in which the expression of at least one gene that downregulate glycolysis and calcium metabolism, and more especially genes involved into glycolysis and calcium signaling pathways, such as SERCA3 (Uniprot: Q93084), EZH2 (Uniprot: Q15910) and BCAT (Uniprot:P54687) is repressed or inactivated.

Targeting Genes which Expression Up Regulate(s) Immune Checkpoint Proteins.

One aspect of the present invention is to genetically engineer immune cells by reducing or inactivating the expression of genes involved into the IL-27 signaling pathway, such as IL-27Ra (Uniprot: Q6UWB1).

Without being bound by any theory, it is believed that IL-27 induces, via NFIL3, the expression of at least two Tim-3 and IL10 immunosuppressive molecules (Zhu et al. (2015) An IL-27/NFIL3 signalling axis drives Tim-3 and IL-10 expression and T-cell dysfunction. *Nature communications*. 6:6072). The goal of reducing or inactivating the IL-27 signaling pathway is to prevent inhibitory receptor induced dysfunction. Furthermore, inactivation of IL-27Ra, or its signaling pathway, could inhibit, not only co-inhibitory receptors, but also immunosuppressive cytokine production.

Thus, the present invention also relates to a method of engineering immune cells, in which primary immune cells, or their progenitor or precursor cells are genetically modified to attenuate or inactivate the expression of one or several gene(s) involved into the IL-27 signaling pathway, especially IL-27RA. The invention is also directed toward engineered primary immune cells, progenitor or precursor cells thereof, in which the expression IL-27 signaling pathway, more particularly IL-27Ra is reduced or inactivated.

Another aspect of this invention is to reduce or inactivate the expression of gene(s) that up regulate(s) immune checkpoint proteins (e.g. TIM3, CEACAM, LAG3, TIGIT), such as IL27RA, STAT1 and/or STAT3, preferably STAT1 (Uniprot:P42224) and STAT3 (Uniprot: P40763).

According to a preferred embodiment, the invention is directed toward engineered primary immune cells, progenitor or precursor cells thereof, in which the expression of IL-27RA, STAT1 or STAT3 is combined with the repression or inactivation of an immune checkpoint protein.

Targeting Genes which Expression Mediate(s) Interaction with HLA-G,

The present invention further relates to a method of engineering immune cells, in which primary immune cells, or their progenitor or precursor cells are genetically modified to attenuate or inactivate the expression of one or several genes that mediate interaction with HLA-G.

Without being bound by any theory, downregulation of immune effector cell function is believed to lay on activation of inhibitory receptors, which relies on the interaction between ILT2 and/or ILT4 receptors with HLA-G molecule. HLA-G has been shown to be expressed in many types of primary solid tumors, metastases and in malignant effusions [Carosella et al (2008) *Trends in Immunology* 29(3):125-132]. HLA-G expression was found to be associated with malignant transformation and correlates with solid tumors of high histological grades or advanced clinical stages and is used as prognostic marker (as well as the soluble level of HLA-G). Meanwhile, it has been shown that an HLA-G overexpressing tumor can develop in vivo and tolerize the host antitumor response (Loumagne et al. (2014) In vivo evidence that secretion of HLA-G by immunogenic tumor cells allows their evasion from immunosurveillance. *Int. J. Cancer.* 135(9):2107-17). Finally, HLA-G has also been shown to impair antigen-specific T cell cytotoxicity (Le Gal et al. (1999) HLA-G-mediated inhibition of antigen-specific cytotoxic T lymphocytes. *Int. Immunol.* 11(8):1351-6). Altogether this has been regarded by the inventors as an involvement of HLA-G in immune surveillance and progression of the disease. Also, according to one embodiment, the inventors suggest inactivating ITL2 (Uniprot: Q8NHL6) and/or ITL4 (Uniprot: Q8N423), their receptors or their downstream signaling pathway in immune cells to prevent from HLA-G induced exhaustion and/or dysfunction.

The invention is thus directed toward engineered primary immune cells, progenitor or precursor cells thereof, in which the expression ITL2 (Uniprot: Q8NHL6) and/or ITL4 (Uniprot: Q8N423), or their receptors is reduced or inactivated.

Targeting Genes which Expression is(are) Involved into the Down Regulation of T-Cell Proliferation One aspect of the present invention is to genetically engineer immune cells by reducing or inactivating the expression of genes involved into the down regulation of T-cell proliferation. T-cell proliferation is known to be tightly regulated by several regulatory pathways.

As part of this aspect, one embodiment is to reduce or inactivate the expression of genes involved into Treg proliferation, such as SEMA7A (Uniprot:O75326) and SHARPIN (Uniprot:Q9H0F6).

As part of this aspect, one embodiment is to reduce or inactivate the expression of genes involved into apoptosis, such as STAT1 (Uniprot:P42224), to lower apoptosis.

As part of this aspect, one embodiment is to reduce or inactivate the expression of genes involved into the downregulation of IL-2 secretion, such as PEA15 (Uniprot: Q15121) in order to increase IL-2 secretion.

As part of this aspect, one embodiment is to favor CD8 memory differentiation by reducing or inactivating the expression of RICTOR (Uniprot: Q6R327).

The present invention is thus directed toward engineered primary immune cells, progenitor or precursor cells thereof, in which the expression of at least one gene involved into the down regulation of T-cell proliferation, in particular SEMA7, SHARPIN, STAT1, PEA15, or RICTOR is reduced or inactivated.

Targeting Genes which Expression is(are) Involved into the Down Regulation of T-Cell Activation, One aspect of the present invention is to genetically engineer immune cells by reducing or inactivating the expression of genes involved into the down regulation of T-cell activation, especially that specifying miR21.

miRNA21 is a mammalian microRNA that is encoded by the MIR21 gene [Lagos-*Quintana* M. et al. (2001). "Identification of novel genes coding for small expressed RNAs". *Science.* 294 (5543): 853-8]. It was one of the first mammalian microRNAs identified. The mature miR-21 sequence is strongly conserved throughout evolution. The human microRNA-21 gene is located on plus strand of chromosome 17q23.2 (55273409-55273480) within a coding gene TMEM49 (also called vacuole membrane protein). Despite being located in intronic regions of a coding gene in the direction of transcription, it has its own promoter regions and forms a ~3433-nt long primary transcript of miR-21 (known as pri-miR-21) which is independently transcribed. The stem-loop precursor of miR-21(pre-miR-21) resides between nucleotides 2445 and 2516 of pri-miR-21.

The present invention is thus directed toward engineered primary immune cells, progenitor or precursor cells thereof, in which miR21 has been genetically modified or inactivated.

Targeting Genes which Expression is(are) Involved in Signaling Pathways Responding to Cytokines One aspect of the present invention is to genetically engineer immune cells by reducing or inactivating the expression of genes involved in the signaling pathways responding to externally produced cytokines, such as JAK2 (Uniprot: 060674) and AURKA (014965). The inventors have indeed realized that tumors often inhibit T-cells immune functions by producing cytokines which act on these proteins and triggers negative feedback on immune cells as though the immune response was sufficient.

The present invention is thus directed toward engineered primary immune cells, progenitor or precursor cells thereof, in which JAK2 or AURKA has been genetically modified or inactivated.

Targeting Genes which Expression is(are) Involved in T-Cell Exhaustion

One aspect of the present invention is to genetically engineer immune cells by reducing or inactivating the expression of genes involved in T-cell exhaustion, such as DNMT3 (Uniprot: Q9Y6K1), miRNA31(NCBI Gene ID: 407035), MT1A (Uniprot:P04731), MT2A (Uniprot: P02795) and/or PTGER2 (Uniprot: P43116).

The present invention is thus directed toward engineered primary immune cells, progenitor or precursor cells thereof, in which at least one gene selected from DNMT3 (Uniprot: Q9Y6K1), miRNA31(NCBI Gene ID: 407035), MT1A (Uniprot:P04731), MT2A (Uniprot:P02795) and/or PTGER2 (Uniprot: P43116) is repressed or inactivated.

Targeting JAK-STAT Pathway to Make Cells, which are Less Alloreactive

One aspect of the present invention is to genetically engineer immune cells by reducing or inactivating the expression of one or several genes involved in the JAK-STAT pathway.

The JAK-STAT signaling pathway transmits information from extracellular chemical signals to the nucleus resulting in DNA transcription and expression of genes involved in immunity, proliferation, differentiation, apoptosis and oncogenesis. The JAK-STAT signaling cascade consists of three main components: a cell surface receptor, a Janus kinase (JAK) and two Signal Transducer and Activator of Transcription (STAT) proteins.

Disrupted or dysregulated JAK-STAT functionality usually result in immune deficiency syndromes and cancers. However, as far as primary immune cells are concerned, the inventors have surprisingly observed that this could have a beneficial effect when using allogeneic therapeutic cells. Indeed JAK-STAT deficient cells ([JAK]$^{neg}$ or [STAT]$^{neg}$) have been found to be less alloreactive.

The present invention is thus directed toward engineered primary immune cells, progenitor or precursor cells thereof, in which at least one gene selected from JAK and STAT is repressed or inactivated.

This invention is thus particularly useful for developing engineered allogeneic immune cells for immunotherapy thereby increasing the persistence and/or the engraftment of such allogeneic immune cells into patients.

According to preferred aspects of this invention, a further gene inactivation is performed to reduce or inactivate the expression of TCR, such as the genes encoding TCR-alpha or TCR-beta in order to reduce graft versus host disease (GvHD) reaction or immune rejection upon introduction of the allogeneic cells into the recipient patient.

As another preferred aspect, one gene editing step is added to reduce or prevent the expression of the ß2m protein and/or another protein involved in its regulation such as C2TA (Uniprot P33076) or in MHC recognition, such as HLA proteins. This also permits the engineered immune cells to be less alloreactive when infused into patients. Most preferred, is the gene editing of both TCR and ß2m.

The present invention is thus directed toward engineered primary immune cells, progenitor or precursor cells thereof, in which at least one gene selected from JAK and STAT is repressed or inactivated, together with at least one gene encoding TCR and/or ß2m.

Combining the Inactivation of Endogenous Genomic Sequences with Further Gene Inactivations One further goal of the present invention is also to combine at least one of the gene inactivation or repression previously described with further gene inactivation, disclosed or undisclosed in the art, to obtain an increase, preferably a cumulative effect, or even preferably a synergistic effect, on the engineered immune cells potency.

The method of the present invention can thus be performed in cells that have been already engineered (i.e. with a genetic background comprising such gene inactivations), or may comprise one or several additional step(s) of gene editing at additional loci in view of obtaining one of the additional effects outlined below.

Preference is given to the production of the resulting engineered immune cells having one of the genotypes detailed in Table 1.

Inhibiting Checkpoint Receptors and Immune Cells Inhibitory Pathways:

According to a preferred aspect of the invention, one of the gene editing steps, aims to disrupt the expression of a protein involved in immune cells inhibitory pathways, in particular those referred to in the literature as "immune checkpoint" [Pardoll, D. M. (2012) The blockade of immune checkpoints in cancer immunotherapy, *Nature Reviews Cancer*, 12:252-264].

"Immune checkpoints" are molecules in the immune system that either turn up a signal (co-stimulatory molecules) or turn down a signal of activation of an immune cell.

As per the present invention, immune checkpoints more particularly designate surface proteins involved in the ligand-receptor interactions between T cells and antigen-presenting cells (APCs) that regulate the T cell response to antigen (which is mediated by peptide-major histocompatibility complex (MHC) molecule complexes that are recognized by the T cell receptor (TCR)). These interactions can occur at the initiation of T cell responses in lymph nodes (where the major APCs are dendritic cells) or in peripheral tissues or tumors (where effector responses are regulated). One important family of membrane-bound ligands that bind both co-stimulatory and inhibitory receptors is the B7 family. All of the B7 family members and their known ligands belong to the immunoglobulin superfamily. Many of the receptors for more recently identified B7 family members have not yet been identified. Tumour necrosis factor (TNF) family members that bind to cognate TNF receptor family molecules represent a second family of regulatory ligand-receptor pairs. These receptors predominantly deliver co-stimulatory signals when engaged by their cognate ligands. Preferred gene targets for inactivating the activity of checkpoint receptors are PD1 (Uniprot Q15116), CTLA4 (Uniprot P16410), PPP2CA (Uniprot P67775), PPP2CB (Uniprot P62714), PTPN6 (Uniprot P29350), PTPN22 (Uniprot Q9Y2R2), LAG3 (Uniprot P18627), HAVCR2 (Uniprot Q8TDQ0), BTLA (Uniprot Q7Z6A9), CD160 (Uniprot 095971), TIGIT (Uniprot Q495A1), CD96 (Uniprot P40200), CRTAM (Uniprot 095727), LAIR1 (Uniprot Q6GTX8), SIGLEC7 (Uniprot Q9Y286), SIGLEC9 (Uniprot Q9Y336), CD244 (Uniprot Q9BZW8), TNFRSF10B (Uniprot 014763), TNFRSF10A (Uniprot 000220), CASP8 (Uniprot Q14790), CASP10 (Uniprot Q92851), CASP3 (Uniprot P42574), CASP6 (Uniprot P55212), CASP7 (Uniprot P55210), FADD (Uniprot Q13158), FAS (Uniprot P25445), TGFBRII (Uniprot P37173), TGFBRI (Uniprot Q15582), SMAD2 (Uniprot Q15796), SMAD3 (Uniprot P84022), SMAD4 (Uniprot Q13485), SMAD10 (Uniprot B7ZSB5), SKI (Uniprot P12755), SKIL (Uniprot P12757), TGIF1 (Uniprot Q15583), IL10RA (Uniprot Q13651), IL10RB (Uniprot Q08334), HMOX2 (Uniprot P30519), IL6R (Uniprot P08887), IL6ST (Uniprot P40189), EIF2AK4 (Uniprot Q9P2K8), CSK (Uniprot P41240), PAG1 (Uniprot Q9NWQ8), SIT1 (Uniprot Q9Y3P8), FOXP3 (Uniprot Q9BZS1), PRDM1 (Uniprot Q60636), BATF (Uniprot Q16520), GUCY1A2 (Uniprot P33402), GUCY1A3 (Uniprot Q02108), GUCY1B2 (Uniprot Q8BXH3) and GUCY1B3 (Uniprot Q02153).

The gene editing introduced in the genes encoding the above proteins is preferably combined with an inactivation of TCR in CAR T cells.

Preference is given to inactivation of PD1 and CTLA4, more particularly in combination with TCR.

To improve the efficiency of the engineered cells according to the present invention, the steps of the present method using sequence-specific endonuclease reagents, can be followed by a step of contacting said engineered immune cells with at least one non-endogenous immunosuppressive polypeptide, such as a PD-L1 ligand and/or CTLA-4 Ig in-vitro or in-vivo.

Inhibiting Suppressive Cytokines/Metabolites

According to another aspect of the invention, the additional gene editing step concerns genes encoding or positively regulating suppressive cytokines or metabolites or receptors thereof, in particular TGFbeta (Uniprot P01137), IL10R (Uniprot Q13651 and/or Q08334), A2aR (Uniprot P29274), GCN2 (Uniprot P15442) and PRDM1 (Uniprot 075626).

Inducing Resistance to Chemotherapy Drugs

As a preferred embodiment of the present method, one gene editing step is performed into a locus responsible for the sensitivity of the immune cells to compounds used in standard of care treatments for cancer or infection, such as drugs purine nucleotide analogs (PNA) or 6-Mercaptopurine (6MP) and 6 thio-guanine (6TG) commonly used in chemotherapy. Reducing or inactivating the genes involved into the mode of action of such compounds (referred to as "drug sensitizing genes") improves the resistance of the immune cells to same.

Examples of drug sensitizing gene are those encoding DCK (Uniprot P27707) with respect to the activity of PNA, such a clorofarabine et fludarabine, HPRT (Uniprot P00492) with respect to the activity of purine antimetabolites such as 6MP and 6TG, and GGH (Uniprot Q92820) with respect to the activity of antifolate drugs, in particular methotrexate.

According to another aspect, resistance to drugs can be conferred immune cells by overexpressing a drug resistance gene as an additional optional step of the present method of sequential gene editing. Expression of variant alleles of several genes such as dihydrofolate reductase (DHFR)(Uniprot P00374), inosine monophosphate dehydrogenase 2 (IMPDH2)(Uniprot P12268), calcineurin (Uniprot Q96LZ3, P63098 P48454, P16298 and Q08209) or methylguanine transferase (MGMT) (Uniprot P16455) have been identified to confer drug resistance to a cell according to the invention.

According to another aspect of the present invention, the engineering immune cells are made resistant to drugs purine nucleotide analogs (PNA) chemotherapy drugs, such a clorofarabine et fludarabine, as part of the gene editing step. This enables the cells to be used after or in combination with conventional anti-cancer chemotherapies.

While, according to the present invention, the first gene editing step is preferably performed on a locus encoding or regulating a surface antigen, so that sorting of the engineered cells can be carried out based on the presence/absence of said surface antigen, the second or ultimate gene editing step can be one conferring resistance of the cells to a compound, preferably a chemotherapy drug or an immune suppressive agent. By doing so, the double or triple gene edited cells can be selected and enriched by a culture step that takes place after the second or ultimate gene editing step. Also, the present method provides a first gene editing step into at least one gene encoding a T-Cell Receptor (TCR) component, in particular TCRalpha (Uniprot P01848) and TCRbeta (Uniprot P01850) and sequentially a second gene editing step into a gene expressing DCK, HPRT or GGH, to confer respectively resistance to PNA compounds, purine antimetabolites and antifolate compounds.

Resistance to Antibodies Immune-Suppressive Treatments

According to another aspect of the present invention, the engineering immune cells are made resistant to immune-depletion treatments, such as those involving glucocorticoids or antibodies directed against immune cells surface proteins. As an example, the antibody Alemtuzumab is used to deplete CD52 positive immune cells as in many pre-cancer treatments.

Also the method of the invention can comprise a gene editing step with respect to the genes encoding or regulating the expression of CD52 (Uniprot P31358) and/or GR (Glucocorticoids receptor also referred to as NR3C1—Uniprot P04150), optionally in combination with a gene editing step leading to a reduction of the inactivation of the TCR. This approach was previously described by Poirot, L. et al. (Multiplex Genome-Edited T-cell Manufacturing Platform for "Off-the-Shelf" Adoptive T-cell Immunotherapies (2013) Cancer. Res. 75:3853), but as part of a method where the different loci were simultaneously gene edited.

Preferred engineered immune cells are those triple or quadruple gene edited cells detailed herein, in which CD52 and or GR are additionally inactivated.

Combining the Inactivation of Endogenous Genomic Sequences with Targeted Sequence Insertion(s) in Immune Cells One particular focus of the present invention is to perform gene inactivation in primary immune cells at a locus, by integrating exogenous coding sequence at said locus, the expression of which improves the therapeutic potential of said engineered cells. Examples of relevant exogenous coding sequences that can be inserted according to the invention have been presented above in connection with their positive effects on the therapeutic potential of the cells. Here below are presented the endogenous gene that are preferably targeted by gene targeted insertion and the advantages associated with their inactivation.

According to a preferred aspect of the invention, the insertion of the coding sequence has the effect of reducing or preventing the expression of genes involved into self and non-self recognition to reduce host versus graft disease (GVHD) reaction or immune rejection upon introduction of the allogeneic cells into a recipient patient. For instance, one of the sequence-specific reagents used in the method can reduce or prevent the expression of TCR in primary T-cells, such as the genes encoding TCR-alpha or TCR-beta.

As another preferred aspect, one gene editing step is to reduce or prevent the expression of the ß2m protein and/or another protein involved in its regulation such as C2TA (Uniprot P33076) or in MHC recognition, such as HLA proteins. This permits the engineered immune cells to be less alloreactive when infused into patients.

By "allogeneic therapeutic use" is meant that the cells originate from a donor in view of being infused into patients having a different haplotype. Indeed, the present invention provides with an efficient method for obtaining primary cells, which can be gene edited in various gene loci involved into host-graft interaction and recognition.

Other loci may also be edited in view of improving the activity, the persistence of the therapeutic activity of the engineered primary cells as detailed here after:

Inactivation of Checkpoint Receptors and Immune Cells Inhibitory Pathways:

According to a preferred aspect of the invention, the inserted exogenous coding sequence has the effect of reducing or preventing the expression of a protein involved in immune cells inhibitory pathways, in particular those referred to in the literature as "immune checkpoint" (Pardoll, D. M. (2012) The blockade of immune checkpoints in cancer immunotherapy, *Nature Reviews Cancer*, 12:252-264). In the sense of the present invention, "immune cells inhibitory pathways" means any gene expression in immune cells that leads to a reduction of the cytotoxic activity of the lymphocytes towards malignant or infected cells. This can be for instance a gene involved into the expression of FOXP3, which is known to drive the activity of Tregs upon T cells (moderating T-cell activity).

"Immune checkpoints" are molecules in the immune system that either turn up a signal (co-stimulatory molecules) or turn down a signal of activation of an immune cell. As per the present invention, immune checkpoints more particularly designate surface proteins involved in the ligand-receptor interactions between T cells and antigen-presenting cells (APCs) that regulate the T cell response to antigen (which is mediated by peptide-major histocompatibility complex (MHC) molecule complexes that are recognized by the T cell receptor (TCR)). These interactions can occur at the initiation of T cell responses in lymph nodes (where the major APCs are dendritic cells) or in peripheral tissues or tumours (where effector responses are regulated). One important family of membrane-bound ligands that bind both co-stimulatory and inhibitory receptors is the B7 family. All of the B7 family members and their known ligands belong to the immunoglobulin superfamily. Many of the receptors for more recently identified B7 family members have not yet been identified. Tumour necrosis factor (TNF) family members that bind to cognate TNF receptor family molecules represent a second family of regulatory ligand-receptor pairs. These receptors predominantly deliver co-stimulatory signals when engaged by their cognate ligands. Another major category of signals that regulate the activation of T cells comes from soluble cytokines in the microenvironment. In other cases, activated T cells upregulate ligands, such as CD40L, that engage cognate receptors on APCs. A2aR, adenosine A2a receptor; B7RP1, B7-related protein 1; BTLA, B and T lymphocyte attenuator; GAL9, galectin 9; HVEM, herpesvirus entry mediator; ICOS, inducible T cell co-stimulator; IL, interleukin; KIR, killer cell immunoglobulin-like receptor; LAG3, lymphocyte activation gene 3; PD1, programmed cell death protein 1; PDL, PD1 ligand; TGFβ, transforming growth factor-β; TIM3, T cell membrane protein 3.

Examples of further endogenous genes, which expression could be reduced or suppressed to turn-up activation in the engineered immune cells according the present invention are listed in Table 3.

For instance, the inserted exogenous coding sequence(s) can have the effect of reducing or preventing the expression, by the engineered immune cell of at least one protein selected from PD1 (Uniprot Q15116), CTLA4 (Uniprot P16410), PPP2CA (Uniprot P67775), PPP2CB (Uniprot P62714), PTPN6 (Uniprot P29350), PTPN22 (Uniprot Q9Y2R2), LAG3 (Uniprot P18627), HAVCR2 (Uniprot Q8TDQ0), BTLA (Uniprot Q7Z6A9), CD160 (Uniprot O95971), TIGIT (Uniprot Q495A1), CD96 (Uniprot P40200), CRTAM (Uniprot O95727), LAIR1 (Uniprot Q6GTX8), SIGLEC7 (Uniprot Q9Y286), SIGLEC9 (Uniprot Q9Y336), CD244 (Uniprot Q9BZW8), TNFRSF10B (Uniprot O14763), TNFRSF10A (Uniprot O00220), CASP8 (Uniprot Q14790), CASP10 (Uniprot Q92851), CASP3 (Uniprot P42574), CASP6 (Uniprot P55212), CASP7 (Uniprot P55210), FADD (Uniprot Q13158), FAS (Uniprot P25445), TGFBRII (Uniprot P37173), TGFRBRI (Uniprot Q15582), SMAD2 (Uniprot Q15796), SMAD3 (Uniprot P84022), SMAD4 (Uniprot Q13485), SMAD10 (Uniprot B7ZSB5), SKI (Uniprot P12755), SKIL (Uniprot P12757), TGIF1 (Uniprot Q15583), IL10RA (Uniprot Q13651), IL10RB (Uniprot Q08334), HMOX2 (Uniprot P30519), IL6R (Uniprot P08887), IL6ST (Uniprot P40189), EIF2AK4 (Uniprot Q9P2K8), CSK (Uniprot P41240), PAG1 (Uniprot Q9NWQ8), SIT1 (Uniprot Q9Y3P8), FOXP3 (Uniprot Q9BZS1), PRDM1 (Uniprot Q60636), BATF (Uniprot Q16520), GUCY1A2 (Uniprot P33402), GUCY1A3 (Uniprot Q02108), GUCY1B2 (Uniprot Q8BXH3) and GUCY1B3 (Uniprot Q02153). The gene editing introduced in the genes encoding the above proteins is preferably combined with an inactivation of TCR in CAR T cells.

Inhibiting Suppressive Cytokines/Metabolites

According to another aspect of the invention, the inserted exogenous coding sequence has the effect of reducing or preventing the expression of genes encoding or positively regulating suppressive cytokines or metabolites or receptors thereof, in particular TGFbeta (Uniprot:P01137), TGFbR (Uniprot:P37173), IL10 (Uniprot:P22301), IL10R (Uniprot: Q13651 and/or Q08334), A2aR (Uniprot: P29274), GCN2 (Uniprot: P15442) and PRDM1 (Uniprot: O75626).

Preference is given to engineered immune cells in which a sequence encoding IL-2, IL-12 or IL-15 replaces the sequence of at least one of the above endogenous genes.

Inducing Resistance to Chemotherapy Drugs

According to another aspect of the present method, the inserted exogenous coding sequence has the effect of reducing or preventing the expression of a gene responsible for the sensitivity of the immune cells to compounds used in standard of care treatments for cancer or infection, such as drugs purine nucleotide analogs (PNA) or 6-Mercaptopurine (6MP) and 6 thio-guanine (6TG) commonly used in chemotherapy. Reducing or inactivating the genes involved into the mode of action of such compounds (referred to as "drug sensitizing genes") improves the resistance of the immune cells to same.

Examples of drug sensitizing gene are those encoding DCK (Uniprot P27707) with respect to the activity of PNA, such a clorofarabine et fludarabine, HPRT (Uniprot P00492) with respect to the activity of purine antimetabolites such as 6MP and 6TG, and GGH (Uniprot Q92820) with respect to the activity of antifolate drugs, in particular methotrexate.

This enables the cells to be used after or in combination with conventional anti-cancer chemotherapies.

Resistance to Immune-Suppressive Treatments

According to another aspect of the present invention, the inserted exogenous coding sequence has the effect of reducing or preventing the expression of receptors or proteins, which are drug targets, making said cells resistant to immune-depletion drug treatments. Such target can be glucocorticoids receptors or antigens, to make the engineered immune cells resistant to glucocorticoids or immune depletion treatments using antibodies such as Alemtuzumab, which is used to deplete CD52 positive immune cells in many cancer treatments.

Also the method of the invention can comprise gene targeted insertion in endogenous gene(s) encoding or regulating the expression of CD52 (Uniprot P31358) and/or GR (Glucocorticoids receptor also referred to as NR3C1— Uniprot P04150).

Further Improving Therapeutic Immune Cells by Expression of Transgenes at the Inactivated Loci The present invention aims to improve the potency of immune cells through gene repression or inactivation techniques, which also includes gene targeted integration.

By "gene targeting integration" is meant any known site-specific methods allowing to insert, replace or correct a genomic sequence into a living cell. Gene targeted integration usually involves the mechanisms of homologous gene recombination or NHEJ (Non homologous Ends Joining), which are enhanced by endonuclease sequence specific reagents, to result into insertion or replacement of at least one exogenous nucleotide, preferably a sequence of several nucleotides (i.e. polynucleotide), and more preferably a coding sequence at a predefined locus.

"Exogenous sequence" refers to any nucleotide or nucleic acid sequence that was not initially present at the selected locus. This sequence may be homologous to, or a copy of, a genomic sequence, or be a foreign sequence introduced into the cell. By opposition "endogenous sequence" means a cell genomic sequence initially present at a locus. The exogenous sequence preferably codes for a polypeptide which expression confers a therapeutic advantage over sister cells that have not integrated this exogenous sequence at the locus.

The method of the present invention can be associated with other methods involving genetic transformations, such as a viral transduction, and also may be combined with other transgene expression not necessarily involving integration.

According to one aspect, the method according to the invention comprises the steps of introducing into an immune cell a mutation or polynucleotide coding sequence at an endogenous locus selected from:
a) polynucleotide sequence(s), which expression is(are) involved into reduction of glycolysis and calcium signaling in response to a low glucose condition, such as SERCA3 to increase calcium signaling, miR101 and mir26A to increase glycolysis, BCAT to mobilize glycolytic reserves; and/or
b) polynucleotide sequence(s), which expression up regulate(s) immune checkpoint proteins (e.g. TIM3, CEACAM, LAG3, TIGIT), such as IL27RA, STAT1, STAT3; and/or
c) polynucleotide sequence(s), which expression mediate(s) interaction with HLA-G, such as ILT2 or ILT4; and/or
d) polynucleotide sequence(s), which expression is(are) involved into the down regulation of T-cell proliferation such as SEMA7A, SHARPIN to reduce Treg proliferation, STAT1 to lower apoptosis, PEA15 to increase IL-2 secretion and RICTOR to favor CD8 memory differentiation; and/or
e) polynucleotide sequence(s), which expression is(are) involved into the down regulation of T-cell activation, such as mir21; and/or
f) polynucleotide sequence(s), which expression is(are) involved in signaling pathways responding to cytokines, such as JAK2 and AURKA; and/or
g) polynucleotide sequence(s), which expression is(are) involved in T-cell exhaustion, such as DNMT3, miRNA31, MT1A, MT2A, PTGER2;

preferably, by expressing into said cell a sequence-specific reagent that specifically targets said selected endogenous locus.

Said transgene or exogenous polynucleotide sequence is preferably inserted so that its expression is placed under transcriptional control of at least one endogenous promoter present at one of said locus.

Targeting one locus as referred to above by performing gene integration is beneficial to further improve the potency of the therapeutic immune cells of the invention.

Examples of such exogenous sequences or transgenes that can be expressed or over-expressed at the selected loci are given hereafter:
Expression of Transgenes Conferring Resistance to Drugs or Immune Depletion Agents According to one aspect of the present method, the exogenous sequence that is integrated into the immune cells genomic locus encodes a molecule that confers resistance of said immune cells to a drug.

Examples of preferred exogenous sequences are variants of dihydrofolate reductase (DHFR) conferring resistance to folate analogs such as methotrexate, variants of inosine monophosphate dehydrogenase 2 (IMPDH2) conferring resistance to IMPDH inhibitors such as mycophenolic acid (MPA) or its prodrug mycophenolate mofetil (MMF), variants of calcineurin or methylguanine transferase (MGMT) conferring resistance to calcineurin inhibitor such as FK506 and/or CsA, variants of mTOR such as mTORmut conferring resistance to rapamycin) and variants of Lck, such as Lckmut conferring resistance to Imatinib and Gleevec.

The term "drug" is used herein as referring to a compound or a derivative thereof, preferably a standard chemotherapy agent that is generally used for interacting with a cancer cell, thereby reducing the proliferative or living status of the cell. Examples of chemotherapeutic agents include, but are not limited to, alkylating agents (e.g., cyclophosphamide, ifosamide), metabolic antagonists (e.g., purine nucleoside antimetabolite such as clofarabine, fludarabine or 2'-deoxyadenosine, methotrexate (MTX), 5-fluorouracil or derivatives thereof), antitumor antibiotics (e.g., mitomycin, adriamycin), plant-derived antitumor agents (e.g., vincristine, vindesine, Taxol), cisplatin, carboplatin, etoposide, and the like. Such agents may further include, but are not limited to, the anti-cancer agents TRIMETHOTRIXATE™ (TMTX), TEMOZOLOMIDE™, RALTRITREXED™, S-(4-Nitrobenzyl)-6-thioinosine (NBMPR),6-benzyguanidine (6-BG), bis-chloronitrosourea (BCNU) and CAMPTOTHECIN™, or a therapeutic derivative of any thereof.

As used herein, an immune cell is made "resistant or tolerant" to a drug when said cell, or population of cells is modified so that it can proliferate, at least in-vitro, in a culture medium containing half maximal inhibitory concentration (IC50) of said drug (said IC50 being determined with respect to an unmodified cell(s) or population of cells).

In a particular embodiment, said drug resistance can be conferred to the immune cells by the expression of at least one "drug resistance coding sequence". Said drug resistance coding sequence refers to a nucleic acid sequence that confers "resistance" to an agent, such as one of the chemotherapeutic agents referred to above. A drug resistance coding sequence of the invention can encode resistance to anti-metabolite, methotrexate, vinblastine, cisplatin, alkylating agents, anthracyclines, cytotoxic antibiotics, anti-immunophilins, their analogs or derivatives, and the like (Takebe, N., S. C. Zhao, et al. (2001) "Generation of dual resistance to 4-hydroperoxycyclophosphamide and methotrexate by retroviral transfer of the human aldehyde dehydrogenase class 1 gene and a mutated dihydrofolate reductase gene". *Mol. Ther.* 3(1): 88-96), (Zielske, S. P., J. S. Reese, et al. (2003) "In vivo selection of MGMT(P140K) lentivirus-transduced human NOD/SCID repopulating cells without pretransplant irradiation conditioning." *J. Clin. Invest.* 112 (10): 1561-70) (Nivens, M. C., T. Felder, et al. (2004) "Engineered resistance to camptothecin and antifolates by retroviral coexpression of tyrosyl DNA phosphodiesterase-I and thymidylate synthase" Cancer Chemother Pharmacol 53(2): 107-15), (Bardenheuer, W., K. Lehmberg, et al. (2005). "Resistance to cytarabine and gemcitabine and in vitro selection of transduced cells after retroviral expression of cytidine deaminase in human hematopoietic progenitor cells". *Leukemia* 19(12): 2281-8), (Kushman, M. E., S. L. Kabler, et al. (2007) "Expression of human glutathione S-transferase P1 confers resistance to benzo[a]pyrene or benzo[a]pyrene-7,8-dihydrodiol mutagenesis, macromolecular alkylation and formation of stable N2-Gua-BPDE adducts in stably transfected V79MZ cells co-expressing hCYP1A1" *Carcinogenesis* 28(1): 207-14).

The expression of such drug resistance exogenous sequences in the immune cells as per the present invention more particularly allows the use of said immune cells in cell therapy treatment schemes where cell therapy is combined with chemotherapy or into patients previously treated with these drugs.

Several drug resistance coding sequences have been identified that can potentially be used to confer drug resistance according to the invention. One example of drug resistance coding sequence can be for instance a mutant or modified form of Dihydrofolate reductase (DHFR). DHFR is an enzyme involved in regulating the amount of tetrahydrofolate in the cell and is essential to DNA synthesis. Folate analogs such as methotrexate (MTX) inhibit DHFR and are thus used as anti-neoplastic agents in clinic. Different mutant forms of DHFR which have increased resistance to inhibition by anti-folates used in therapy have been described. In a particular embodiment, the drug resistance coding sequence according to the present invention can be a nucleic acid sequence encoding a mutant form of human wild type DHFR (GenBank: AAH71996.1), which comprises at least one mutation conferring resistance to an anti-folate treatment, such as methotrexate. In particular embodiment, mutant form of DHFR comprises at least one mutated amino acid at position G15, L22, F31 or F34, preferably at positions L22 or F31 (Schweitzer et al. (1990) "Dihydrofolate reductase as a therapeutic target" Faseb J4(8): 2441-52; International application WO94/24277; and U.S. Pat. No. 6,642,043). In a particular embodiment, said DHFR mutant form comprises two mutated amino acids at position L22 and F31. Correspondence of amino acid positions described herein is frequently expressed in terms of the positions of the amino acids of the form of wild-type DHFR polypeptide. In a particular embodiment, the serine residue at position 15 is preferably replaced with a tryptophan residue. In another particular embodiment, the leucine residue at position 22 is preferably replaced with an amino acid which will disrupt binding of the mutant DHFR to antifolates, preferably with uncharged amino acid residues such as phenylalanine or tyrosine. In another particular embodiment, the phenylalanine residue at positions 31 or 34 is preferably replaced with a small hydrophilic amino acid such as alanine, serine or glycine.

Another example of drug resistance coding sequence can also be a mutant or modified form of ionisine-5'-monophosphate dehydrogenase II (IMPDH2), a rate-limiting enzyme in the de novo synthesis of guanosine nucleotides. The mutant or modified form of IMPDH2 is a IMPDH inhibitor resistance gene. IMPDH inhibitors can be mycophenolic acid (MPA) or its prodrug mycophenolate mofetil (MMF). The mutant IMPDH2 can comprises at least one, preferably two mutations in the MAP binding site of the wild type human IMPDH2 (Genebank: NP_000875.2) leading to a significantly increased resistance to IMPDH inhibitor. Mutations in these variants are preferably at positions T333 and/or S351 (Yam, P., M. Jensen, et al. (2006) "Ex vivo selection and expansion of cells based on expression of a mutated inosine monophosphate dehydrogenase 2 after HIV vector transduction: effects on lymphocytes, monocytes, and CD34+ stem cells" Mol. Ther. 14(2): 236-44)(Jonnalagadda, M., et al. (2013) "Engineering human T cells for resistance to methotrexate and mycophenolate mofetil as an in vivo cell selection strategy." PLoS One 8(6): e65519).

Another drug resistance coding sequence is the mutant form of calcineurin. Calcineurin (PP2B-NCBI: ACX34092.1) is an ubiquitously expressed serine/threonine protein phosphatase that is involved in many biological processes and which is central to T-cell activation. Calcineurin is a heterodimer composed of a catalytic subunit (CnA; three isoforms) and a regulatory subunit (CnB; two isoforms). After engagement of the T-cell receptor, calcineurin dephosphorylates the transcription factor NFAT, allowing it to translocate to the nucleus and active key target gene such as IL2. FK506 in complex with FKBP12, or cyclosporine A (CsA) in complex with CyPA block NFAT access to calcineurin's active site, preventing its dephosphorylation and thereby inhibiting T-cell activation (Brewin et al. (2009) "Generation of EBV-specific cytotoxic T cells that are resistant to calcineurin inhibitors for the treatment of post transplantation lymphoproliferative disease" Blood 114(23): 4792-803). In a particular embodiment, said mutant form can comprise at least one mutated amino acid of the wild type calcineurin heterodimer a at positions: V314, Y341, M347, T351, W352, L354, K360, preferably double mutations at positions T351 and L354 or V314 and Y341. In a particular embodiment, the valine residue at position 341 can be replaced with a lysine or an arginine residue, the tyrosine residue at position 341 can be replaced with a phenylalanine residue; the methionine at position 347 can be replaced with the glutamic acid, arginine or tryptophane residue; the threonine at position 351 can be replaced with the glutamic acid residue; the tryptophane residue at position 352 can be replaced with a cysteine, glutamic acid or alanine residue, the serine at position 353 can be replaced with the histidine or asparagines residue, the leucine at position 354 can be replaced with an alanine residue; the lysine at position 360 can be replaced with an alanine or phenylalanine residue. In another particular embodiment, said mutant form can comprise at least one mutated amino acid of the wild type calcineurin heterodimer b at positions: V120, N123, L124 or K125, preferably double mutations at positions L124 and K125. In a particular embodiment, the valine at position 120 can be replaced with a serine, an aspartic acid, phenylalanine or leucine residue; the asparagines at position 123 can be replaced with a tryptophan, lysine, phenylalanine, arginine, histidine or serine; the leucine at position 124 can be replaced with a threonine residue; the lysine at position 125 can be replaced with an alanine, a glutamic acid, tryptophan, or two residues such as leucine-arginine or isoleucine-glutamic acid can be added after the lysine at position 125 in the amino acid sequence. Correspondence of amino acid positions described herein is frequently expressed in terms of the positions of the amino acids of the form of wild-type human calcineurin heterodimer b polypeptide (NCBI: ACX34095.1).

Another drug resistance coding sequence is 0(6)-methylguanine methyltransferase (MGMT-UniProtKB: P16455) encoding human alkyl guanine transferase (hAGT). AGT is a DNA repair protein that confers resistance to the cytotoxic effects of alkylating agents, such as nitrosoureas and temozolomide (TMZ). 6-benzylguanine (6-BG) is an inhibitor of AGT that potentiates nitrosourea toxicity and is co-administered with TMZ to potentiate the cytotoxic effects of this agent. Several mutant forms of MGMT that encode variants of AGT are highly resistant to inactivation by 6-BG, but retain their ability to repair DNA damage (Maze, R. et al. (1999) "Retroviral-mediated expression of the P140A, but not P140A/G156A, mutant form of O6-methylguanine DNA methyltransferase protects hematopoietic cells against O6-benzylguanine sensitization to chloroethylnitrosourea treatment" J. Pharmacol. Exp. Ther. 290(3): 1467-74). In a particular embodiment, AGT mutant form can comprise a mutated amino acid of the wild type AGT position P140. In a preferred embodiment, said proline at position 140 is replaced with a lysine residue.

Another drug resistance coding sequence can be multidrug resistance protein (MDR1) gene. This gene encodes a membrane glycoprotein, known as P-glycoprotein (P-GP) involved in the transport of metabolic byproducts across the cell membrane. The P-Gp protein displays broad specificity towards several structurally unrelated chemotherapy agents.

Thus, drug resistance can be conferred to cells by the expression of nucleic acid sequence that encodes MDR-1 (Genebank NP_000918).

Another drug resistance coding sequence can contribute to the production of cytotoxic antibiotics, such as those from ble or mcrA genes. Ectopic expression of ble gene or mcrA in an immune cell gives a selective advantage when exposed to the respective chemotherapeutic agents bleomycine and mitomycin C (Belcourt, M. F. (1999) "Mitomycin resistance in mammalian cells expressing the bacterial mitomycin C resistance protein MCRA". *PNAS.* 96(18):10489-94).

Another drug resistance coding sequence can come from genes encoded mutated version of drug targets, such as mutated variants of mTOR (mTOR mut) conferring resistance to rapamycin such as described by Lorenz M. C. et al. (1995) "TOR Mutations Confer Rapamycin Resistance by Preventing Interaction with FKBP12-Rapamycin" *The Journal of Biological Chemistry* 270, 27531-27537, or certain mutated variants of Lck (Lckmut) conferring resistance to Gleevec as described by Lee K. C. et al. (2010) "Lck is a key target of imatinib and dasatinib in T-cell activation", *Leukemia,* 24: 896-900.

As described above, the genetic modification step of the method can comprise a step of introduction into cells of an exogeneous nucleic acid comprising at least a sequence encoding the drug resistance coding sequence and a portion of an endogenous gene such that homologous recombination occurs between the endogenous gene and the exogeneous nucleic acid. In a particular embodiment, said endogenous gene can be the wild type "drug resistance" gene, such that after homologous recombination, the wild type gene is replaced by the mutant form of the gene which confers resistance to the drug.

Expression of Transgene Enhancing Persistence of the Immune Cells In-Vivo

According to one aspect of the present method, the exogenous sequence that is integrated into the immune cells genomic locus encodes a molecule that enhances persistence of the immune cells, especially in-vivo persistence in a tumor environment.

By "enhancing persistence" is meant extending the survival of the immune cells in terms of life span, especially once the engineered immune cells are injected into the patient. For instance, persistence is enhanced, if the mean survival of the modified cells is significantly longer than that of non-modified cells, by at least 10%, preferably 20%, more preferably 30%, even more preferably 50%.

This especially relevant when the immune cells are allogeneic. This may be done by creating a local immune protection by introducing coding sequences that ectopically express and/or secrete immunosuppressive polypeptides at, or through, the cell membrane. A various panel of such polypeptides in particular antagonists of immune checkpoints, immunosuppressive peptides derived from viral envelope or NKG2D ligand can enhance persistence and/or an engraftment of allogeneic immune cells into patients.

According to one embodiment, the immunosuppressive polypeptide to be encoded by said exogenous coding sequence is a ligand of Cytotoxic T-Lymphocyte Antigen 4 (CTLA-4 also known as CD152, GenBank accession number AF414120.1). Said ligand polypeptide is preferably an anti-CTLA-4 immunoglobulin, such as CTLA-4a Ig and CTLA-4b Ig or a functional variant thereof.

According to one embodiment, the immunosuppressive polypeptide to be encoded by said exogenous coding sequence is an antagonist of PD1, such as PD-L1 (other names: CD274, Programmed cell death 1 ligand; ref. Uni-Prot for the human polypeptide sequence Q9NZQ7), which encodes a type I transmembrane protein of 290 amino acids consisting of a Ig V-like domain, a Ig C-like domain, a hydrophobic transmembrane domain and a cytoplasmic tail of 30 amino acids. Such membrane-bound form of PD-L1 ligand is meant in the present invention under a native form (wild-type) or under a truncated form such as, for instance, by removing the intracellular domain, or with one or more mutation(s) (Wang S et al., 2003, *J Exp Med.* 2003; 197(9): 1083-1091). Of note, PD1 is not considered as being a membrane-bound form of PD-L1 ligand according to the present invention. According to another embodiment, said immunosuppressive polypeptide is under a secreted form. Such recombinant secreted PD-L1 (or soluble PD-L1) may be generated by fusing the extracellular domain of PD-L1 to the Fc portion of an immunoglobulin (Haile S T et al., 2014, *Cancer Immunol. Res.* 2(7): 610-615; Song M Y et al., 2015, Gut. 64(2):260-71). This recombinant PD-L1 can neutralize PD-1 and abrogate PD-1-mediated T-cell inhibition. PD-L1 ligand may be co-expressed with CTLA4 Ig for an even enhanced persistence of both.

According to another embodiment, the exogenous sequence encodes a non-human MHC homolog, especially a viral MHC homolog, or a chimeric β2m polypeptide such as described by Margalit A. et al. (2003) "Chimeric β2 microglobulin/CD3ζ polypeptides expressed in T cells convert MHC class I peptide ligands into T cell activation receptors: a potential tool for specific targeting of pathogenic CD8+ T cells" *Int. Immunol.* 15 (11): 1379-1387.

According to one embodiment, the exogenous sequence encodes NKG2D ligand. Some viruses such as cytomegaloviruses have acquired mechanisms to avoid NK cell mediate immune surveillance and interfere with the NKG2D pathway by secreting a protein able to bind NKG2D ligands and prevent their surface expression (Welte, S. A et al. (2003) "Selective intracellular retention of virally induced NKG2D ligands by the human cytomegalovirus UL16 glycoprotein". *Eur. J. Immunol.,* 33, 194-203). In tumors cells, some mechanisms have evolved to evade NKG2D response by secreting NKG2D ligands such as ULBP2, MICB or MICA (Salih H R, Antropius H, Gieseke F, Lutz S Z, Kanz L, et al. (2003) Functional expression and release of ligands for the activating immunoreceptor NKG2D in leukemia. *Blood* 102: 1389-1396)

According to one embodiment, the exogenous sequence encodes a cytokine receptor, such as an IL-12 receptor. IL-12 is a well known activator of immune cells activation (Curtis J. H. (2008) "IL-12 Produced by Dendritic Cells Augments CD8+ T Cell Activation through the Production of the Chemokines CCL1 and CCL171". *The Journal of Immunology.* 181 (12): 8576-8584.

According to one embodiment the exogenous sequence encodes an antibody that is directed against inhibitory peptides or proteins. Said antibody is preferably be secreted under soluble form by the immune cells. Nanobodies from shark and camels are advantageous in this respect, as they are structured as single chain antibodies (Muyldermans S. (2013) "Nanobodies: Natural Single-Domain Antibodies" *Annual Review of Biochemistry* 82: 775-797). Same are also deemed more easily to fuse with secretion signal polypeptides and with soluble hydrophilic domains.

The different aspects developed above to enhance persistence of the cells are particularly preferred, when the exogenous coding sequence is introduced by disrupting an endogenous gene encoding β2m or another MHC component, as detailed further on.

Expression of Transgenes Enhancing the Therapeutic Activity of Immune Cells

According to one aspect of the present method, the exogenous sequence that is integrated into the immune cells genomic locus encodes a molecule that enhances the therapeutic activity of the immune cells.

By "enhancing the therapeutic activity" is meant that the immune cells, or population of cells, engineered according to the present invention, become more aggressive than non-engineered cells or population of cells with respect to a selected type of target cells. Said target cells consists of a defined type of cells, or population of cells, preferably characterized by common surface marker(s). In the present specification, "therapeutic potential" reflects the therapeutic activity, as measured through in-vitro experiments. In general sensitive cancer cell lines, such as Daudi cells, are used to assess whether the immune cells are more or less active towards said cells by performing cell lysis or growth reduction measurements. This can also be assessed by measuring levels of degranulation of immune cells or chemokines and cytokines production. Experiments can also be performed in mice with injection of tumor cells, and by monitoring the resulting tumor expansion. Enhancement of activity is deemed significant when the number of developing cells in these experiments is reduced by the immune cells by more than 10%, preferably more than 20%, more preferably more than 30%, even more preferably by more than 50%.

According to one aspect of the invention, said exogenous sequence encodes a chemokine or a cytokine, such as IL-12. It is particularly advantageous to express IL-12 as this cytokine is extensively referred to in the literature as promoting immune cell activation (Colombo M. P. et al. (2002) "Interleukin-12 in anti-tumor immunity and immunotherapy" *Cytokine Growth Factor Rev.* 13(2):155-68).

According to a preferred aspect of the invention the exogenous coding sequence encodes or promote secreted factors that act on other populations of immune cells, such as T-regulatory cells, to alleviate their inhibitory effect on said immune cells.

According to one aspect of the invention, said exogenous sequence encodes an inhibitor of regulatory T-cell activity is a polypeptide inhibitor of forkhead/winged helix transcription factor 3 (FoxP3), and more preferably is a cell-penetrating peptide inhibitor of FoxP3, such as that referred as P60 (Casares N. et al. (2010) "A peptide inhibitor of FoxP3 impairs regulatory T cell activity and improves vaccine efficacy in mice." *J Immunol* 185(9):5150-9).

By "inhibitor of regulatory T-cells activity" is meant a molecule or precursor of said molecule secreted by the T-cells and which allow T-cells to escape the down regulation activity exercised by the regulatory T-cells thereon. In general, such inhibitor of regulatory T-cell activity has the effect of reducing FoxP3 transcriptional activity in said cells.

According to one aspect of the invention, said exogenous sequence encodes a secreted inhibitor of Tumor Associated Macrophages (TAM), such as a CCR2/CCL2 neutralization agent. Tumor-associated macrophages (TAMs) are critical modulators of the tumor microenvironment. Clinicopathological studies have suggested that TAM accumulation in tumors correlates with a poor clinical outcome. Consistent with that evidence, experimental and animal studies have supported the notion that TAMs can provide a favorable microenvironment to promote tumor development and progression. (Theerawut C. et al. (2014) "Tumor-Associated Macrophages as Major Players in the Tumor Microenvironment" *Cancers (Basel)* 6(3): 1670-1690). Chemokine ligand 2 (CCL2), also called monocyte chemoattractant protein 1 (MCP1—NCBI NP_002973.1), is a small cytokine that belongs to the CC chemokine family, secreted by macrophages, that produces chemoattraction on monocytes, lymphocytes and basophils. CCR2 (C-C chemokine receptor type 2—NCBI NP_001116513.2), is the receptor of CCL2.

Although the coding sequence which is inserted at said locus generally encodes polypeptide(s) improving the therapeutic potential of the engineered immune cells, the inserted sequence can also be a nucleic acid able to direct or repress expression of other genes, such as interference RNAs or guide-RNAs. The polypeptides encoded by the inserted sequence may act directly or indirectly, such as signal transducers or transcriptional regulators.

Improving the Efficiency of Gene Targeted Insertion in Primary Immune Cells Using AAV Vectors The inventors have significantly improved the rate of gene targeted insertion into immune cells by using AAV vectors, especially vectors from the AAV6 family or chimeric vectors AAV2/6 previously described by Sharma A., et al. [Transduction efficiency of AAV 2/6, 2/8 and 2/9 vectors for delivering genes in human corneal fibroblasts. (2010) Brain Research Bulletin. 81 (2-3): 273-278].

One aspect of the present invention is thus the transduction of AAV vectors in human primary immune cells, in conjunction with the expression of sequence-specific endonuclease reagents, such as TALE endonucleases, to increase gene integration at the loci previously cited.

According to a preferred aspect of this invention, sequence specific endonuclease reagents can be introduced into the cells by transfection, more preferably by electroporation of mRNA encoding said sequence specific endonuclease reagents.

Still according to this aspect, the invention more particularly provides a method of insertion of an exogenous nucleic acid sequence into said endogenous loci, comprising at least the steps of:

transducing into said cell an AAV vector comprising said exogenous nucleic acid sequence and sequences homologous to the targeted endogenous DNA sequence, and optionally Inducing the expression of a sequence specific endonuclease reagent to cleave said endogenous sequence at the locus of insertion.

wherein said endogenous sequence is selected from:
   a) polynucleotide sequence(s), which expression is(are) involved into reduction of glycolysis and calcium signaling in response to a low glucose condition, such as SERCA3 to increase calcium signaling, miR101 and mir26A to increase glycolysis, BCAT to mobilize glycolytic reserves; and/or
   b) polynucleotide sequence(s), which expression up regulate(s) immune checkpoint proteins (e.g. TIM3, CEACAM, LAG3, TIGIT), such as IL27RA, STAT1, STAT3; and/or
   c) polynucleotide sequence(s), which expression mediate (s) interaction with HLA-G, such as ILT2 or ILT4; and/or
   d) polynucleotide sequence(s), which expression is(are) involved into the down regulation of T-cell proliferation such as SEMA7A, SHARPIN to reduce Treg proliferation, STAT1 to lower apoptosis, PEA15 to increase IL-2 secretion and RICTOR to favor CD8 memory differentiation; and/or
   e) polynucleotide sequence(s), which expression is(are) involved into the down regulation of T-cell activation, such as mir21; and/or f) polynucleotide sequence(s), which expression is(are) involved in signaling pathways responding to cytokines, such as JAK2 and AURKA.

g) polynucleotide sequence(s), which expression is(are) involved in T-cell exhaustion, such as DNMT3, miRNA31, MT1A, MT2A, PTGER2;

The obtained insertion of the exogenous nucleic acid sequence may result into the introduction of genetic material, correction or replacement of the endogenous sequence, more preferably "in frame" with respect to the endogenous gene sequences at that locus.

According to another aspect of the invention, from $10^5$ to $10^7$ preferably from $10^6$ to 107, more preferably about $5.10^6$ viral genomes viral genomes are transduced per cell.

According to another aspect of the invention, the cells can be treated with proteasome inhibitors, such as Bortezomib or HDAC inhibitors to further help homologous recombination.

As one object of the present invention, the AAV vector used in the method can comprise an exogenous coding sequence that is promoterless, said coding sequence being any of those referred to in this specification.

As one object of the present invention, the AAV vector used in the method can comprise a 2A peptide cleavage site followed by the cDNA (minus the start codon) forming the exogenous coding sequence.

As one object of the present invention, said AAV vector comprises an exogenous sequence coding for a chimeric receptor, for instance a chimeric antigen receptor (CAR), especially an anti-CD19 CAR, an anti-CD22 CAR, an anti-CD123 CAR, an anti-CS1 CAR, an anti-CCL1 CAR, an anti-HSP70 CAR, an anti-GD3 CAR or an anti-ROR1 CAR.

The invention thus encompasses any AAV vectors designed to perform the method herein described, especially vectors comprising a sequence homologous to a locus of insertion selected from:

a) polynucleotide sequence(s), which expression is(are) involved into reduction of glycolysis and calcium signaling in response to a low glucose condition, such as SERCA3 to increase calcium signaling, miR101 and mir26A to increase glycolysis, BCAT to mobilize glycolytic reserves; and/or b) polynucleotide sequence(s), which expression up regulate(s) immune checkpoint proteins (e.g. TIM3, CEACAM, LAG3, TIGIT), such as IL27RA, STAT1, STAT3; and/or c) polynucleotide sequence(s), which expression mediate (s) interaction with HLA-G, such as ILT2 or ILT4; and/or d) polynucleotide sequence(s), which expression is(are) involved into the down regulation of T-cell proliferation such as SEMA7A, SHARPIN to reduce Treg proliferation, STAT1 to lower apoptosis, PEA15 to increase IL-2 secretion and RICTOR to favor CD8 memory differentiation; and/or e) polynucleotide sequence(s), which expression is(are) involved into the down regulation of T-cell activation, such as mir21; and/or f) polynucleotide sequence(s), which expression is(are) involved in signaling pathways responding to cytokines, such as JAK2 and AURKA; and/or g) polynucleotide sequence(s), which expression is(are) involved in T-cell exhaustion, such as DNMT3, miRNA31, MT1A, MT2A, PTGER2;

Many other vectors known in the art, such as plasmids, episomal vectors, linear DNA matrices, etc. . . . can also be used to perform gene insertions at those loci by following the teachings of the present invention.

As stated before, the DNA vector used according to the invention preferably comprises: (1) said exogenous nucleic acid comprising the exogenous coding sequence to be inserted, and (2) a sequence encoding the sequence specific endonuclease reagent that promotes said insertion. According to a more preferred aspect, said exogenous nucleic acid under (1) does not comprise any promoter sequence, whereas the sequence under (2) has its own promoter. According to an even more preferred aspect, the nucleic acid under (1) comprises an Internal Ribosome Entry Site (IRES) or "self-cleaving" 2A peptides, such as T2A, P2A, E2A or F2A, so that the endogenous gene where the exogenous coding sequence is inserted becomes multi-cistronic. The IRES of 2A Peptide can precede or follow said exogenous coding sequence.

Engineered Immune Cells and Populations of Immune Cells

The present invention is also drawn to the variety of engineered immune cells obtainable according to one of the method described previously under isolated form or as part of populations of cells.

According to a preferred aspect of the invention the engineered cells are primary immune cells, such as NK cells or T-cells, which are generally part of populations of cells that may involve different types of cells. In general, population deriving from patients or donors isolated by leukapheresis from PBMC (peripheral blood mononuclear cells).

The present invention encompasses immune cells comprising any combinations of the different exogenous coding sequences and gene inactivation, which have been respectively and independently described above. Among these combinations are particularly preferred those combining the expression of a CAR under the transcriptional control of an endogenous promoter that is active during immune cell activation, in particular one promoter present at one TCR locus, in particular a TCRalpha promoter.

Another preferred combination is the insertion of an exogenous sequence encoding a CAR or one of its constituents under the transcription control of the hypoxia-inducible factor 1 gene promoter (Uniprot: Q16665).

The invention is also drawn to a pharmaceutical composition comprising an engineered primary immune cell or immune cell population as previously described for the treatment of infection or cancer, and to a method for treating a patient in need thereof, wherein said method comprises:

preparing a population of engineered primary immune cells according to the method of the invention as previously described;

optionally, purifying or sorting said engineered primary immune cells;

activating said population of engineered primary immune cells upon or after infusion of said cells into said patient.

Activation and Expansion of T Cells

Whether prior to or after genetic modification, the immune cells according to the present invention can be activated or expanded, even if they can activate or proliferate independently of antigen binding mechanisms. T-cells, in particular, can be activated and expanded using methods as described, for example, in U.S. Pat. Nos. 6,352,694; 6,534,055; 6,905,680; 6,692,964; 5,858,358; 6,887,466; 6,905,681; 7,144,575; 7,067,318; 7,172,869; 7,232,566; 7,175,843; 5,883,223; 6,905,874; 6,797,514; 6,867,041; and U.S. Patent Application Publication No. 20060121005. T cells can be expanded in vitro or in vivo. T cells are generally expanded by contact with an agent that stimulates a CD3 TCR complex and a co-stimulatory molecule on the surface of the T cells to create an activation signal for the T-cell. For example, chemicals such as calcium ionophore A23187, phorbol 12-myristate 13-acetate (PMA), or mitogenic lectins like phytohemagglutinin (PHA) can be used to create an activation signal for the T-cell.

As non-limiting examples, T cell populations may be stimulated in vitro such as by contact with an anti-CD3 antibody, or antigen-binding fragment thereof, or an anti-CD2 antibody immobilized on a surface, or by contact with a protein kinase C activator (e.g., bryostatin) in conjunction with a calcium ionophore. For co-stimulation of an accessory molecule on the surface of the T cells, a ligand that binds the accessory molecule is used. For example, a population of T cells can be contacted with an anti-CD3 antibody and an anti-CD28 antibody, under conditions appropriate for stimulating proliferation of the T cells. Conditions appropriate for T cell culture include an appropriate media (e.g., Minimal Essential Media or RPMI Media 1640 or, X-vivo 5, (Lonza)) that may contain factors necessary for proliferation and viability, including serum (e.g., fetal bovine or human serum), interleukin-2 (IL-2), insulin, IFN-g, IL-4, IL-7, GM-CSF, IL-10, IL-2, IL-15, TGFp, and TNF- or any other additives for the growth of cells known to the skilled artisan. Other additives for the growth of cells include, but are not limited to, surfactant, plasmanate, and reducing agents such as N-acetyl-cysteine and 2-mercaptoethanoi. Media can include RPMI 1640, A1M-V, DMEM, MEM, a-MEM, F-12, X-Vivo 1, and X-Vivo 20, Optimizer, with added amino acids, sodium pyruvate, and vitamins, either serum-free or supplemented with an appropriate amount of serum (or plasma) or a defined set of hormones, and/or an amount of cytokine(s) sufficient for the growth and expansion of T cells. Antibiotics, e.g., penicillin and streptomycin, are included only in experimental cultures, not in cultures of cells that are to be infused into a subject. The target cells are maintained under conditions necessary to support growth, for example, an appropriate temperature (e.g., 37° C.) and atmosphere (e.g., air plus 5% C02). T cells that have been exposed to varied stimulation times may exhibit different characteristics In another particular embodiment, said cells can be expanded by co-culturing with tissue or cells. Said cells can also be expanded in vivo, for example in the subject's blood after administrating said cell into the subject.

Therapeutic Compositions and Applications

The method of the present invention described above allows producing engineered primary immune cells within a limited time frame of about 15 to 30 days, preferably between 15 and 20 days, and most preferably between 18 and 20 days so that they keep their full immune therapeutic potential, especially with respect to their cytotoxic activity.

These cells form a population of cells, which preferably originate from a single donor or patient. These populations of cells can be expanded under closed culture recipients to comply with highest manufacturing practices requirements and can be frozen prior to infusion into a patient, thereby providing "off the shelf" or "ready to use" therapeutic compositions.

As per the present invention, a significant number of cells originating from the same Leukapheresis can be obtained, which is critical to obtain sufficient doses for treating a patient. Although variations between populations of cells originating from various donors may be observed, the number of immune cells procured by a leukapheresis is generally about from $10^8$ to $10^{10}$ cells of PBMC. PBMC comprises several types of cells: granulocytes, monocytes and lymphocytes, among which from 30 to 60% of T-cells, which generally represents between $10^8$ to $10^9$ of primary T-cells from one donor. The method of the present invention generally ends up with a population of engineered cells that reaches generally more than about $10^8$ T-cells, more generally more than about $10^9$ T-cells, even more generally more than about $10^{10}$ T-cells, and usually more than $10^{11}$ T-cells.

The invention is thus more particularly drawn to a therapeutically effective population of primary immune cells, wherein at least 30%, preferably 50%, more preferably 80% of the cells in said population have been modified according to any one the methods described herein.

According to a preferred aspect of the invention, more than 50% of the immune cells comprised in said population are TCR negative T-cells. According to a more preferred aspect of the invention, more than 50% of the immune cells comprised in said population are CAR positive T-cells.

The immune cells according to the present invention are generally endowed with recombinant receptors, such as CAR or recombinant TCR, which confer them higher specificity toward malignant or infected cells. These recombinant receptors are generally encoded by exogenous polynucleotides which are introduced into the cell using viral vectors as per one of the transduction steps referred to previously.

The CARs expressed by these cells specifically target antigen markers at the surface of malignant or infected cells, which further help said immune cells to destroy these cells in-vivo as reviewed by Sadelain M. et al. ["The basic principles of chimeric antigen receptor design" (2013) *Cancer Discov.* 3(4):388-98].

In general, CAR polypeptides comprise an antigen binding domain, a transmembrane domain, and an intracellular domain comprising a costimulatory domain and/or a primary signaling domain, wherein said antigen binding domain binds to the tumor antigen associated with the disease.

Many CARs have been described in the art, which can be used to carry out the present method, or to prepare the engineered cells of the invention, preferably the TRAC A KO gene engineered cells of the invention which can bind tumor antigen as diverse as one selected from: CD19 molecule (CD19); membrane spanning 4-domains A1 (MS4A1 also known as CD20); CD22 molecule (CD22); CD24 molecule (CD24); CD248 molecule (CD248); CD276 molecule (CD276 or B7H3); CD33 molecule (CD33); CD38 molecule (CD38); CD44v6; CD70 molecule (CD70); CD72; CD79a; CD79b; interleukin 3 receptor subunit alpha (IL3RA also known as CD123); TNF receptor superfamily member 8 (TNFRSF8 also known as CD30); KIT proto-oncogene receptor tyrosine kinase (CD117); V-set pre-B cell surrogate light chain 1 (VPREB1 or CD179a); adhesion G protein-coupled receptor E5 (ADGRE5 or CD97); TNF receptor superfamily member 17 (TNFRSF17 also known as BCMA); SLAM family member 7 (SLAMF7 also known as CS1); L1 cell adhesion molecule (L1CAM); C-type lectin domain family 12 member A (CLEC12A also known as CLL-1); tumor-specific variant of the epidermal growth factor receptor (EGFRvIII); thyroid stimulating hormone receptor (TSHR); Fms related tyrosine kinase 3 (FLT3); ganglioside GD3 (GD3); Tn antigen (Tn Ag); lymphocyte antigen 6 family member G6D (LY6G6D); Delta like canonical Notch ligand 3 (DLL3); Interleukin-13 receptor subunit alpha-2 (IL-13RA2); Interleukin 11 receptor subunit alpha (IL11 RA); mesothelin (MSLN); Receptor tyrosine kinase like orphan receptor 1 (ROR1); Prostate stem cell antigen (PSCA); erb-b2 receptor tyrosine kinase 2 (ERBB2 or Her2/neu); Protease Serine 21 (PRSS21); Kinase insert domain receptor (KDR also known as VEGFR2); Lewis y antigen (LewisY); Solute carrier family 39 member 6 (SLC39A6); Fibroblast activation protein alpha (FAP); Hsp70 family chaperone (HSP70); Platelet-derived growth factor receptor beta (PDGFR-beta); Cholinergic receptor nicotinic alpha 2 subunit (CHRNA2); Stage-Specific Embryonic Antigen-4 (SSEA-4); Mucin 1, cell surface associated (MUC1); mucin 16, cell surface associated (MUC16); claudin 18 (CLDN18); claudin 6 (CLDN6); Epidermal Growth Factor Receptor (EGFR); Preferentially expressed antigen in melanoma (PRAME); Neural Cell Adhesion Molecule (NCAM); ADAM metallopeptidase domain 10 (ADAM10); Folate receptor 1 (FOLR1); Folate receptor beta (FOLR2); Carbonic Anhydrase IX (CA9); Proteasome subunit beta 9 (PSMB9 or LMP2); Ephrin receptor A2 (EphA2); Tetraspanin 10 (TSPAN10); Fucosyl GM1 (Fuc-GM1); sialyl Lewis adhesion molecule (sLe); TGS5; high molecular weight-melanoma-associated antigen (HMW-MAA); o-acetyl-GD2 ganglioside (OAcGD2); tumor endothelial marker 7-related (TEM7R); G protein-coupled receptor class C group 5, member D (GPRC5D); chromosome X open reading frame 61 (CXORF61); ALK receptor tyrosine kinase (ALK); Polysialic acid; Placenta-specific 1 (PLAC1); hexasaccharide portion of globoH glycoceramide (GloboH); NY-BR-1 antigen; uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 family member K (LY6K); olfactory receptor family 51 subfamily E member 2 (OR51E2); TCR Gamma Alternate Reading Frame Protein (TARP); Wilms tumor protein (WT1); ETV6-AML1 fusion protein due to 12;21 chromosomal translocation (ETV6-AML1); sperm autoantigenic protein 17 (SPA17); X Antigen Family, Member 1E (XAGE1E); TEK receptor tyrosine kinase (Tie2); melanoma cancer testis antigen-1 (MAD-CT-1); melanoma cancer testis antigen-2 (MAD-CT-2); Fos-related antigen 1; p53 mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B 1; v-myc avian myelocytomatosis viral oncogene neuroblastoma derived homolog (MYCN); Ras Homolog Family Member C (RhoC); Cytochrome P450 1B 1 (CYP1B 1); CCCTC-Binding Factor (Zinc Finger Protein)-Like (BORIS); Squamous Cell Carcinoma Antigen Recognized By T Cells 3 (SART3); Paired box protein Pax-5 (PAX5); proacrosin binding protein sp32 (OY-TES 1); lymphocyte-specific protein tyrosine kinase (LCK); A kinase anchor protein 4 (AKAP-4); synovial sarcoma, X breakpoint 2 (SSX2); Leukocyte-associated immunoglobulin-like receptor 1 (LAIR1); Fc fragment of IgA receptor (FCAR); Leukocyte immunoglobulin-like receptor subfamily A member 2 (LILRA2); CD300 molecule-like family member f (CD300LF); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1).

More preferred CARs according to the present invention are those described in the examples, which more preferably comprise an extracellular binding domain directed against one antigen selected from CD19, CD22, CD33, 5T4, ROR1, CD38, CD52, CD123, CS1, BCMA, Flt3, CD70, EGFRvIII, WT1, HSP-70 and CCL1. Even more preferred are CARs directed against CD22, CD38, 5T4, CD123, CS1, HSP-70 and CCL1. Such CARs have preferably one structure as described in WO2016120216.

Immune cells can also express recombinant T-Cell receptors. T cells recognise MHC-peptide conjugates on target cells through the paired $\alpha$ and $\beta$ chains of the TCR. This pairing confers the antigen specificity of the immune cell. One gene therapy approach has involved the molecular cloning of the TCR genes known to be specific for an antigen of choice. These chains are then introduced into T cells usually by means of a viral vector in a similar way as with CAR. Consequently, expression of the cloned TCR$\alpha$ and TCR$\beta$ genes endows the transduced immune cells with a functional specificity determined by the pairing of these new genes. Because TCRs recognize processed peptides presented on MHC, targeted antigens can be derived from the entire protein composition of the tumor cells, including intracellular proteins, whereas CARs are generally designed to recognize molecules expressed on the surface of target cells. This quality also allows TCRs to target a large number of non-surface antigens of virally infected cells and tumors associated with viral infection, such as hepatitis-associated hepatocellular carcinoma, papilloma virus-associated cervical cancer, and Epstein-Barr virus-related malignancies (Spear, T. et al. (2016). Strategies to genetically engineer T cells for cancer immunotherapy. *Cancer Immunology Immunotherapy:* 65(6):631-649).

Preferred recombinant TCR to be used in the present invention are those directed against antigen specific of cancer cells, such as MART-1, MAGE-1, MAGE-2, MAGE-3 MAGE-12, BAGE, GAGE, NY-ESO-1, or overexpressed in cancer cells, such as a-Fetoprotein, Telomerase catalytic protein, G-250, MUC-1, CarcinoEmbryonic antigen (CEA), p53, Her-2/Neu and WT1 [Rosenberg S. A., (2001) Progress in human tumour immunology and immunotherapy *Nature.* 411(6835):380-4].

Such compositions or populations of cells can therefore be used as medicaments; especially for treating cancer, particularly for the treatment of lymphoma, but also for solid tumors such as melanomas, neuroblastomas, gliomas or carcinomas such as lung, breast, colon, prostate or ovary tumors in a patient in need thereof.

The invention is more particularly drawn to populations of primary TCR negative T-cells originating from a single donor, wherein at least 20%, preferably 30%, more preferably 50% of the cells in said population have been modified using sequence-specific reagents in at least two, preferably three different loci.

In another aspect, the present invention relies on methods for treating patients in need thereof, said method comprising at least one of the following steps:
  (a) Determining specific antigen markers present at the surface of patients tumors biopsies;
  (b) providing a population of engineered primary immune cells engineered by one of the methods of the present invention as previously described, preferably expressing a recombinant receptor directed against said specific antigen markers;
  (c) Administrating said engineered population of engineered primary immune cells to said patient, Generally, said populations of cells mainly comprises CD4 and CD8 positive immune cells, such as T-cells, which can undergo robust in vivo T cell expansion and can persist for an extended amount of time in-vitro and in-vivo.

The treatments involving the engineered primary immune cells according to the present invention can be ameliorating, curative or prophylactic. It may be either part of an autologous immunotherapy or part of an allogenic immunotherapy treatment. By autologous, it is meant that cells, cell line or population of cells used for treating patients are originating from said patient or from a Human Leucocyte Antigen (HLA) compatible donor. By allogeneic is meant that the cells or population of cells used for treating patients are not originating from said patient but from a donor.

In another embodiment, said isolated cell according to the invention or cell line derived from said isolated cell can be used for the treatment of liquid tumors, and preferably of T-cell acute lymphoblastic leukemia.

Adult tumors/cancers and pediatric tumors/cancers are also included.

The treatment with the engineered immune cells according to the invention may be in combination with one or more therapies against cancer selected from the group of antibodies therapy, chemotherapy, cytokines therapy, dendritic cell therapy, gene therapy, hormone therapy, laser light therapy and radiation therapy.

According to a preferred embodiment of the invention, said treatment can be administrated into patients undergoing an immunosuppressive treatment. Indeed, the present invention preferably relies on cells or population of cells, which have been made resistant to at least one immunosuppressive agent due to the inactivation of a gene encoding a receptor for such immunosuppressive agent. In this aspect, the immunosuppressive treatment should help the selection and expansion of the T-cells according to the invention within the patient.

The administration of the cells or population of cells according to the present invention may be carried out in any convenient manner, including by aerosol inhalation, injection, ingestion, transfusion, implantation or transplantation. The compositions described herein may be administered to a patient subcutaneously, intradermally, intratumorally, intranodally, intramedullary, intramuscularly, by intravenous or intralymphatic injection, or intraperitoneally. In one embodiment, the cell compositions of the present invention are preferably administered by intravenous injection.

The administration of the cells or population of cells can consist of the administration of $10^4$-$10^9$ cells per kg body weight, preferably $10^5$ to $10^6$ cells/kg body weight including all integer values of cell numbers within those ranges. The present invention thus can provide more than 10, generally more than 50, more generally more than 100 and usually more than 1000 doses comprising between $10^6$ to $10^8$ gene edited cells originating from a single donor's or patient's sampling.

The cells or population of cells can be administrated in one or more doses. In another embodiment, said effective amount of cells are administrated as a single dose. In another embodiment, said effective amount of cells are administrated as more than one dose over a period time. Timing of administration is within the judgment of managing physician and depends on the clinical condition of the patient. The cells or population of cells may be obtained from any source, such as a blood bank or a donor. While individual needs vary, determination of optimal ranges of effective amounts of a given cell type for a particular disease or conditions within the skill of the art. An effective amount means an amount which provides a therapeutic or prophylactic benefit. The dosage administrated will be dependent upon the age, health and weight of the recipient, kind of concurrent treatment, if any, frequency of treatment and the nature of the effect desired.

In another embodiment, said effective amount of cells or composition comprising those cells are administrated parenterally. Said administration can be an intravenous administration.

Said administration can be directly done by injection within a tumor.

In certain embodiments of the present invention, cells are administered to a patient in conjunction with (e.g., before, simultaneously or following) any number of relevant treatment modalities, including but not limited to treatment with agents such as antiviral therapy, cidofovir and interleukin-2, Cytarabine (also known as ARA-C) or nataliziimab treatment for MS patients or efaliztimab treatment for psoriasis patients or other treatments for PML patients. In further embodiments, the T cells of the invention may be used in combination with chemotherapy, radiation, immunosuppressive agents, such as cyclosporin, azathioprine, methotrexate, mycophenolate, and FK506, antibodies, or other immunoablative agents such as CAMPATH, anti-CD3 antibodies or other antibody therapies, cytoxin, fludaribine, cyclosporin, FK506, rapamycin, mycoplienolic acid, steroids, FR901228, cytokines, and irradiation. These drugs inhibit either the calcium dependent phosphatase calcineurin (cyclosporine and FK506) or inhibit the p70S6 kinase that is important for growth factor induced signaling (rapamycin) (Henderson, Naya et al. 1991; Liu, Albers et al. 1992; Bierer, Hollander et al. 1993). In a further embodiment, the cell compositions of the present invention are administered to a patient in conjunction with (e.g., before, simultaneously or following) bone marrow transplantation, T cell ablative therapy using either chemotherapy agents such as, fludarabine, externalbeam radiation therapy (XRT), cyclophosphamide, or antibodies such as OKT3 or CAMPATH, In another embodiment, the cell compositions of the present invention are administered following B-cell ablative therapy such as agents that react with CD20, e.g., Rituxan. For example, in one embodiment, subjects may undergo standard treatment with high dose chemotherapy followed by peripheral blood stem cell transplantation. In certain embodiments, following the transplant, subjects receive an infusion of the expanded immune cells of the present invention. In an additional embodiment, expanded cells are administered before or following surgery.

When CARs are expressed in the immune cells or populations of immune cells according to the present invention, the preferred CARs are those targeting at least one antigen selected from CD22, CD38, 5T4, CD123, CS1, HSP-70 and CCL1 (or CD19, CD22, CD33, 5T4, ROR1, CD38, CD52, CD123, CS1, BCMA, Flt3, CD70, EGFRvIII, WT1, HSP-70 and CCL1).

The engineered immune cells according to the present invention endowed with a CAR or a modified TCR targeting CD22 are preferably used for treating leukemia, such as acute lymphoblastic leukemia (ALL), those with a CAR or a modified TCR targeting CD38 are preferably used for treating leukemia such as T-cell acute lymphoblastic leukemia (T-ALL) or multiple myeloma (MM), those with a CAR or a modified TCR targeting CD123 are preferably used for treating leukemia, such as acute myeloid leukemia (AML), and blastic plasmacytoid dendritic cells neoplasm (BPDCN), those with a CAR or a modified TCR targeting CS1 are preferably used for treating multiple myeloma (MM).

Other Definitions

Amino acid residues in a polypeptide sequence are designated herein according to the one-letter code, in which, for example, Q means Gln or Glutamine residue, R means Arg or Arginine residue and D means Asp or Aspartic acid residue.

Amino acid substitution means the replacement of one amino acid residue with another, for instance the replacement of an Arginine residue with a Glutamine residue in a peptide sequence is an amino acid substitution.

Nucleotides are designated as follows: one-letter code is used for designating the base of a nucleoside: a is adenine, t is thymine, c is cytosine, and g is guanine. For the degenerated nucleotides, r represents g or a (purine nucleotides), k represents g or t, s represents g or c, w represents a or t, m represents a or c, y represents t or c (pyrimidine nucleotides), d represents g, a or t, v represents g, a or c, b represents g, t or c, h represents a, t or c, and n represents g, a, t or c.

"As used herein, "nucleic acid" or "polynucleotides" refers to nucleotides and/or polynucleotides, such as deoxyribonucleic acid (DNA) or ribonucleic acid (RNA), oligonucleotides, fragments generated by the polymerase chain reaction (PCR), and fragments generated by any of ligation, scission, endonuclease action, and exonuclease action. Nucleic acid molecules can be composed of monomers that are naturally-occurring nucleotides (such as DNA and RNA), or analogs of naturally-occurring nucleotides (e.g., enantiomeric forms of naturally-occurring nucleotides), or a combination of both. Modified nucleotides can have alterations in sugar moieties and/or in pyrimidine or purine base moieties. Sugar modifications include, for example, replacement of one or more hydroxyl groups with halogens, alkyl groups, amines, and azido groups, or sugars can be functionalized as ethers or esters. Moreover, the entire sugar moiety can be replaced with sterically and electronically similar structures, such as aza-sugars and carbocyclic sugar analogs. Examples of modifications in a base moiety include alkylated purines and pyrimidines, acylated purines or pyrimidines, or other well-known heterocyclic substitutes. Nucleic acid monomers can be linked by phosphodiester bonds or analogs of such linkages. Nucleic acids can be either single stranded or double stranded.

The term "endonuclease" refers to any wild-type or variant enzyme capable of catalyzing the hydrolysis (cleavage) of bonds between nucleic acids within a DNA or RNA molecule, preferably a DNA molecule. Endonucleases do not cleave the DNA or RNA molecule irrespective of its sequence, but recognize and cleave the DNA or RNA molecule at specific polynucleotide sequences, further referred to as "target sequences" or "target sites". Endonucleases can be classified as rare-cutting endonucleases when having typically a polynucleotide recognition site greater than 10 base pairs (bp) in length, more preferably of 14-55 bp. Rare-cutting endonucleases significantly increase homologous recombination by inducing DNA double-strand breaks (DSBs) at a defined locus thereby allowing gene repair or gene insertion therapies (Pingoud, A. and G. H. Silva (2007). Precision genome surgery. *Nat. Biotechnol.* 25(7): 743-4.).

By "DNA target", "DNA target sequence", "target DNA sequence", "nucleic acid target sequence", "target sequence", or "processing site" is intended a polynucleotide sequence that can be targeted and processed by a rare-cutting endonuclease according to the present invention. These terms refer to a specific DNA location, preferably a genomic location in a cell, but also a portion of genetic material that can exist independently to the main body of genetic material such as plasmids, episomes, virus, transposons or in organelles such as mitochondria as non-limiting example. As non-limiting examples of RNA guided target sequences, are those genome sequences that can hybridize the guide RNA which directs the RNA guided endonuclease to a desired locus.

By "mutation" is intended the substitution, deletion, insertion of up to one, two, three, four, five, six, seven, eight, nine, ten, eleven, twelve, thirteen, fourteen, fifteen, twenty, twenty five, thirty, fourty, fifty, or more nucleotides/amino acids in a polynucleotide (cDNA, gene) or a polypeptide sequence. The mutation can affect the coding sequence of a gene or its regulatory sequence. It may also affect the structure of the genomic sequence or the structure/stability of the encoded mRNA.

By "vector" is meant a nucleic acid molecule capable of transporting another nucleic acid to which it has been linked. A "vector" in the present invention includes, but is not limited to, a viral vector, a plasmid, a RNA vector or a linear or circular DNA or RNA molecule which may consists of a chromosomal, non chromosomal, semi-synthetic or synthetic nucleic acids. Preferred vectors are those capable of autonomous replication (episomal vector) and/or expression of nucleic acids to which they are linked (expression vectors). Large numbers of suitable vectors are known to those of skill in the art and commercially available. Viral vectors include retrovirus, adenovirus, parvovirus (e.g. adeno-associated viruses (AAV), coronavirus, negative strand RNA viruses such as orthomyxovirus (e.g., influenza virus), rhabdovirus (e.g., rabies and vesicular stomatitis virus), paramyxovirus (e.g. measles and Sendai), positive strand RNA viruses such as picornavirus and alphavirus, and double-stranded DNA viruses including adenovirus, herpesvirus (e.g., Herpes Simplex virus types 1 and 2, Epstein-Barr virus, cytomegalovirus), and poxvirus (e.g., vaccinia, fowlpox and canarypox). Other viruses include Norwalk virus, togavirus, flavivirus, reoviruses, papovavirus, hepadnavirus, and hepatitis virus, for example. Examples of retroviruses include: avian leukosis-sarcoma, mammalian C-type, B-type viruses, D type viruses, HTLV-BLV group, lentivirus, spumavirus (Coffin, J. M., Retroviridae: The viruses and their replication, In Fundamental Virology, Third Edition, B. N. Fields, et al., Eds., Lippincott-Raven Publishers, Philadelphia, 1996).

As used herein, the term "locus" is the specific physical location of a DNA sequence (e.g. of a gene) into a genome. The term "locus" can refer to the specific physical location of a rare-cutting endonuclease target sequence on a chromosome or on an infection agent's genome sequence. Such a locus can comprise a target sequence that is recognized and/or cleaved by a sequence-specific endonuclease according to the invention. It is understood that the locus of interest of the present invention can not only qualify a nucleic acid sequence that exists in the main body of genetic material (i.e. in a chromosome) of a cell but also a portion of genetic material that can exist independently to said main body of genetic material such as plasmids, episomes, virus, transposos or in organelles such as mitochondria as non-limiting examples.

The term "cleavage" refers to the breakage of the covalent backbone of a polynucleotide. Cleavage can be initiated by a variety of methods including, but not limited to, enzymatic or chemical hydrolysis of a phosphodiester bond. Both single-stranded cleavage and double-stranded cleavage are possible, and double-stranded cleavage can occur as a result of two distinct single-stranded cleavage events. Double stranded DNA, RNA, or DNA/RNA hybrid cleavage can result in the production of either blunt ends or staggered ends.

"identity" refers to sequence identity between two nucleic acid molecules or polypeptides. Identity can be determined by comparing a position in each sequence which may be aligned for purposes of comparison. When a position in the compared sequence is occupied by the same base, then the molecules are identical at that position. A degree of similarity or identity between nucleic acid or amino acid sequences is a function of the number of identical or matching nucleotides at positions shared by the nucleic acid sequences. Various alignment algorithms and/or programs may be used to calculate the identity between two sequences, including FASTA, or BLAST which are available as a part of the GCG sequence analysis package (University of Wisconsin, Madison, Wis.), and can be used with, e.g., default setting. For example, polypeptides having at least 70%, 85%, 90%, 95%, 98% or 99% identity to specific polypeptides described herein and preferably exhibiting substantially the same functions, as well as polynucleotide encoding such polypeptides, are contemplated.

"Chimeric antigen receptor" (CAR) is a term that encompasses molecules which combine an extracellular binding domain against a component present on the target cell, for example an antibody-based specificity for a desired antigen (e.g., tumor antigen) with a T cell receptor-activating intracellular domain to generate a chimeric protein that exhibits a specific anti-target cellular immune activity. Generally, CAR consists of an extracellular single chain antibody (scFv), comprising the light ($V_L$) and the heavy ($V_H$) variable fragment of a target antigen specific monoclonal antibody joined by a flexible linker, fused to the intracellular signaling domain of the T cell antigen receptor complex zeta chain and have the ability, when expressed in immune effector cells, to redirect antigen recognition based on the monoclonal antibody's specificity. CAR can be single-chain or multi-chain as described in WO2014039523. Binding domain other than scFv can also be used for predefined targeting of lymphocytes, such as camelid or shark (VNAR) single-domain antibody fragments or receptor ligands like a vascular endothelial growth factor polypeptide, an integrin-binding peptide, heregulin or an IL-13 mutein, antibody binding domains, antibody hypervariable loops or CDRs as non-limiting examples.

"Recombinant TCR" are artificial polypeptide constructs consisting preferably of a single amino acid strand, which like native heterodimeric TCRs bind to MHC-peptide complexes. Recombinant TCRs are preferably single-chain polypeptides, such as described by Stone J. D, et al. [A novel T cell receptor single-chain signaling complex mediates antigen-specific T cell activity and tumor control (2014) *Cancer Immunol. Immunother.* 63(11):1163-76], Such single chain TCRs generally comprise:

an α segment constituted by a human TCR α chain variable region sequence fused to the N terminus of a human TCR α chain constant region extracellular sequence, a β segment constituted by a human TCR β chain variable region sequence fused to the N terminus of a human TCR β chain constant region extracellular sequence, and a linker sequence linking the C terminus of the α segment to the N terminus of the β segment, or vice versa, the constant region extracellular sequences of the α and β segments being linked by a disulfide bond, the length of the linker sequence and the position of the disulfide bond being such that the variable region sequences of the α and β segments are mutually orientated substantially as in native αβ T cell receptors.

by "cytolytic activity" or "cytotoxic activity" or "cytotoxicity" is meant the percentage of cell lysis of target cells conferred by an immune cell.

A method for determining the cytotoxicity is described below:

With adherent target cells: $2 \times 10^4$ specific target antigen (STA)-positive or STA-negative cells are seeded in 0.1 ml per well in a 96 well plate. The day after the plating, the STA-positive and the STA-negative cells are labeled with CellTrace CFSE and co-cultured with $4 \times 10^5$ T cells for 4 hours. The cells are then harvested, stained with a fixable viability dye (eBioscience) and analyzed using the MACSQuant flow cytometer (Miltenyi).

With suspension target cells: STA-positive and STA-negative cells are respectively labeled with CellTrace CFSE and CellTrace Violet. About $2 \times 10^4$ ROR1-positive cells are co-cultured with $2 \times 10^4$ STA-negative cells with $4 \times 10^5$ T cells in 0.1 ml per well in a 96-well plate. After a 4 hour incubation, the cells are harvested and stained with a fixable viability dye (eBioscience) and analyzed using the MACSQuant flow cytometer (Miltenyi).

The percentage of specific lysis can be calculated using the following formula:

$$\% \text{ cell lysis} = 100\% - \frac{\frac{\% \text{ viable target cells upon coculture with CAR modified } T \text{ cells}}{\% \text{ viable control cells upon coculture with CAR modified } T \text{ cells}}}{\frac{\% \text{ viable target cells upon coculture with non modified } T \text{ cells}}{\% \text{ viable control cells upon coculture with non modified } T \text{ cells}}}$$

By "increased cytotoxicity" is meant that the % cell lysis of target cells conferred by the engineered immune cells is increased by at least 10%, such as at least 20%, at least 30%, at least 40%, at least 50%, at least 60%, at least 70%, at least 80%, at least 90% or at least 100% or more, compared to the % cell lysis of target cells conferred by the immune cell not being engineered.

The term "subject" or "patient" as used herein includes all members of the animal kingdom including non-human primates and humans.

The above written description of the invention provides a manner and process of making and using it such that any person skilled in this art is enabled to make and use the same, this enablement being provided in particular for the subject matter of the appended claims, which make up a part of the original description.

Where a numerical limit or range is stated herein, the endpoints are included. Also, all values and subranges within a numerical limit or range are specifically included as if explicitly written out.

Having generally described this invention, a further understanding can be obtained by reference to certain specific examples, which are provided herein for purposes of illustration only, and are not intended to limit the scope of the claimed invention.

EXAMPLES

As described in Poirot et al. (Multiplex Genome-Edited T-cell Manufacturing Platform for "Off-the-Shelf" Adoptive T-cell Immunotherapies (2015) *Cancer Research.* 75(18): 3853-3864), human primary T lymphocytes were activated and transfected with mRNA coding for TALEN® or mock transfected as control. Polypeptide sequences of TALEN® reagents and respective polynucleotide target sequences used for inactivating the different genes according to the invention are respectively detailed in Table 2 and 3 below.

TABLE 2

| Gene | target name | SED ID # | Polynucleotide target sequences |
|---|---|---|---|
| miR21 | miR21_1 | 1 | TGTACCACCTTGTCGGGTAGCTTATCAGACTGATGTTGACTGTTGAA |
| miR21 | miR21_2 | 2 | TACCACCTTGTCGGGTAGCTTATCAGACTGATGTTGACTGTTGAATCTCA |
| miR31 | miR31_1 | 3 | TGTAACTTGGAACTGGAGAGGAGGCAAGATGCTGGCATAGCTGTTGAA |
| miR31 | miR31_2 | 4 | TTGGAACTGGAGAGGAGGCAAGATGCTGGCATAGCTGTTGAACTGGGA |
| STAT1 | STAT1_1 | 5 | TTCCCTATAGGATGTCTCAGTGGTACGAACTTCAGCAGCTTGACTCAAA |
| STAT1 | STAT1_2 | 6 | TGTCTCAGTGGTACGAACTTCAGCAGCTTGACTCAAAATTCCTGGAGCA |
| 26A1 | 26A1_1 | 7 | TGGCGAAGGCCGTGGCCTCGTTCAAGTAATCCAGGATAGGCTGTGCA |
| 26A1 | 26A1_2 | 8 | TCCAGGATAGGCTGTGCAGGTCCCAATGGGCCTATTCTTGGTTACTTGCA |
| miR101 | miR101_1 | 9 | TCCTTCAGTTATCACAGTACTGTACCTTTAGAATAGACAGCATCAGCA |
| miR101 | miR101_2 | 10 | TGGCTGCCATCCTTCAGTTATCACAGTACTGTACCTTTAGAATAGACA |
| mt2a | mt2a_exon1 | 11 | TCCCAACTGCTCCTGCGCCGCCGGTAAGAGGCTGGGGATGCCCAGTGTA |
| mt2a | mt2a_exon2 | 12 | TCCTTGCAGGTGACTCCTGCACCTGCGCCGGCTCCTGCAAATGCAAAGA |
| STAT3 | STAT3_1 | 13 | TGGGACCCCTGATTTTAGCAGGATGGCCCAATGGAATCAGCTACA |
| STAT3 | STAT3_2 | 14 | TCTGGCCCCTTGGATTGAGAGTCAAGATTGGTAAGTCCTTCTTAA |
| Mt1A | Mt1A_ex2_1 | 15 | TCTTCCTTGCAGGTGGCTCCTGCACCTGCACTGGCTCCTGCAAA |
| Mt1A | Mt1A_ex2_2 | 16 | TGCAAATGCACCTCCTGCAAGAAGAGTGAGTGTGGGGCCATCTCCA |
| JAK2 | hsJAK2_1 | 17 | TCCAGTTCTTCAGGTGTATCTTTACCATTCCCTTGGGAAATCTGAGGCA |
| JAK2 | hsJAK2_2 | 18 | TGAGGCAGATTATCTGACCTTTCCATCTGGGGAGTATGTTGCAGAAGAA |
| AURKA | hsAURKA_1 | 19 | TGACTCAGCAATTTCCTTGTCAGAATCCATTACCTGTAAATAGTGGCCA |
| AURKA | hsAURKA_2 | 20 | TTGTCTCCAGTCACAAGCCGGTTCAGAATCAGAAGCAGAAGCAATTGCA |
| ptger2 | ptger2_ex1 | 21 | TTGTTCCACGTGCTGGTGACCGAGCTGGTGTTCACCGACCTGCTCGGGA |
| ptger2 | ptger2_ex2 | 22 | TTTGCTTCTTACAGATTTTTGCATATATGAATGAAACCTCTTCCCGAAA |
| ILT2 | ILT2_1 | 23 | TCCTGATTTCCTTCCAGGGCACCTCCCCAAGCCCACCCTCTGGGCTGAA |
| ILT2 | ILT2_2 | 24 | TGTGAAGAAGGGCCAGTTCCCCATCCCATCCATCACCTGGGAACACACA |
| ILT4 | ILT4_1 | 25 | TTCTCACCTGGGACCAGGAGCTCCAGGAGATCACTGGGTGAAGACCACA |
| ILT4 | ILT4_2 | 26 | TGGGCTGAGAGGGTGGGTTTTGGGTAGGCTCCTAGGAGAGAAGGAGGCA |
| DNMT3A | DNMT3A.1 | 27 | TGGAGGAATGTGCCAAAactgcaaggtaggagCACACCCACCCAGGAGA |
| DNMT3A | DNMT3A.2 | 28 | TGGGTGGAACCTGAGGCagctgcctacgcaccACCTCCACCAGCCAAAA |
| IL27RA | IL27RAex1.1 | 29 | TGTGGGTGCTTTTCCAGcggacgcgtcccagGGTGAGTGCTGGAGGGA |
| IL27RA | IL27RAex2.1 | 30 | TTGGGGACCTGGGAGCCccctccgagttacacCTCCAGAGCCAAAGTA |

TABLE 2-continued polynucleotide genomic sequences targeted by the sequence specific endonuclease reagents used in the examples

| Gene | target name | SED ID # | Polynucleotide target sequences |
|---|---|---|---|
| IL27RA | IL27RAex5_1.1 | 31 | TACCCCTGACCCCTGTTgagatccaagatttgGAGCTAGCCACTGGCTA |
| IL27RA | IL27RAex5_2.1 | 32 | TGGGCTTGCCCTCAATCcacgccctcccaccCCCAGAAGTCTGTCCAA |
| PEA-15 | PEA-15_ex1.1 | 33 | TGCAAGACCTGACCAACaacatcacccttgaaGATCTAGAACAGCTCAA |
| PEA-15 | PEA-15_ex2.1 | 34 | TCCTGCCTTCCTCCAGAcaacctctcctacatTGAGCACATCTTTGAGA |
| Sema7a | Sema7a_1.1 | 35 | TGCGGCTGCTGCTGCTGctctgggcggccgccGCCTCCGCCCAGGGCCA |
| Sema7a | Sema7a_ex2.1 | 36 | TTGTCTCCTCCTCAGGCcatgtagggcaggacCGGGTGGACTTTGGCCA |
| Sharpin | Sharpin_ex2_1.1 | 37 | TCTTCTCAGGTTAATTTggagtggcccctggaGTCAGTTTCCTACACCA |
| Sharpin | Sharpin_ex3.1 | 38 | TATCTTACCTCTAGGCAgcaagagcaactcacCACCAGCCTTGGGCCCA |
| bcat1 | bcat1_ex3_1.1 | 39 | TTTCTTCCCCAGGCTAAagacctaatagtcacACCAGCTACCATTTTAA |
| bcat1 | bcat1_ex4.1 | 40 | TTGATCTCCAGTTATTTgaaggattgaaggcaTTTCGAGGAGTAGATAA |

TABLE 3

Polypeptide sequences of TALEN-reagents used in the examples

| Nickname | SEQ ID # | Target gene | TALEN (Left and Right heterodimers) | TALEN Polypeptide Sequence |
|---|---|---|---|---|
| pCLS29698 | 41 | BCAT1 (exon3) | bcat1_ex3_1-L1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNGGGKQ ALETVQRLLPVLCQAHGLTPQQVVAIASNGGGKQALETVQRLLPVLCQAHGLTPEQVVA IASHDGGKQALETVQRLLPVLCQAHGLTPQQVVAIASNGGGKQALETVQRLLPVLCQAH GLTPQQVVAIASNGGGKQALETVQRLLPVLCQAHGLTPEQVVAIASHDGKQALETVQ RLLPVLCQAHGLTPEQVVAIASHDGGKQALETVQRLLPVLCQAHGLTPEQVVAIASHDG GKQALETVQRLLPVLCQAHGLTPEQVVAIASHDGKQALETVQRLLPVLCQAHGLTPEQ VVAIASNIGGKQALETVQALLPVLCQAHGLTPQQVVAIASNNGGKQALETVQRLLPVLCQ AHGLTPVLCQAHGLTPQQVVAIASNGGGKQALETVQRLLPVLCQAHGLTPEQVVAIASNI GGKQALETVQALLPVLCQAHGLTPQQVVAIAQLSRPDPALAALTN DHLVALACLGGRPALDAVKKGLGDPISRSQLVKSELEEKKSELRHKLKYVPHEYIELIEIA RNSTQDRILEMKVMEFFMKVYGYRGKHLGGSRKPDGAIYTVGSPIDYGVIVDTKAYSGG YNLPIGQADEMQRYVEENQTRNKHINPNEWWKVYPSSVTEFKFLFVSGHFKGNYKAQL TRLNHITNCNGAVLSVEELLIGGEMIKAGTLTLEEVRRKFNNGEINFAAD |
| pCLS29699 | 42 | BCAT1 (exon3) | bcat1_ex3_1-R1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNGGGKQ ALETVQRLLPVLCQAHGLTPEQVVAIASNIGGKQALETVQRLLPVLCQAHGLTPEQVVAI ASNIGGKQALETVQALLPVLCQAHGLTPEQVVAIASNIGGKQALETVQALLPVLCQAHGL TPEQVVAIASNIGGKQALETVQRLLPVLCQAHGLTPQQVVAIASNNGGKQALETVQRLLP VLCQAHGLTPQQVVAIASNGGGKQALETVQRLLPVLCQAHGLTPQQVVAIASNGGGKQ ALETVQRLLPVLCQAHGLTPQQVVAIASNGGGKQALETVQRLLPVLCQAHGLTPEQVVA IASNIGGKQALETVQALLPVLCQAHGLTPQQVVAIASNGGGKQALETVQRLLPVLCQAH GLTPEQVVAIASHDGKGALETVQRLLPVLCQAHGLTPQQVVAIASNGGGKQALETVQ RLLPVLCQAHGLTPVLCQAHGLTPQQVVAIASNGGGKQALETVQRLLPVLCQAHGLTPEQVVAI ASNIGGKQALETVQALLPVLCQAHGLTPQQVVAIASNGGGRPALESIVAQLSRPDPALAALTND HLVALACLGGRPALDAVKKGLGDPISRSQLVKSELEEKKSELRHKLKYVPHEYIELIEIAR NSTQDRILEMKVMEFFMKVYGYRGKHLGGSRKPDGAIYTVGSPIDYGVIVDTKAYSGGY NLPIGQADEMQRYVEENQTRNKHINPNEWWKVYPSSVTEFKFLFVSGHFKGNYKAQLT RLNHITNCNGAVLSVEELLIGGEMIKAGTLTLEEVRRKFNNGEINFAAD |
| pCLS29700 | 43 | BCAT1 (exon4) | bcat1_ex4-L1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNGGGKQ ALETVQRLLPVLCQAHGLTPQQVVAIASNGGGKQALETVQRLLPVLCQAHGLTPEQVVA IASNIGGKQALETVQALLPVLCQAHGLTPQQVVAIASNGGGKQALETVQRLLPVLCQAH GLTPQQVVAIASNGGGKQALETVQRLLPVLCQAHGLTPEQVVAIASHDGKQALETVQ RLLPVLCQAHGLTPEQVVAIASHDGGKQALETVQRLLPVLCQAHGLTPEQVVAIASHDG GKQALETVQRLLPVLCQAHGLTPEQVVAIASNIGGKQALETVQRLLPVLCQAHGLTPQQ VVAIASNGGGKQALETVQRLLPVLCQAHGLTPEQVVAIASNIGGKQALETVQRLLPVLC QAHGLTPEQVVAIASNGGGKQALETVQALLPVLCQAHGLTPQQVVAIASNGGGKQALET VQALLPVLCQAHGLTPQQVVAIASNGGGKQALETVQRLLPVLCQAHGLTPQQVVAIASN |

TABLE 3-continued

Polypeptide sequences of TALEN-reagents used in the examples

| Nickname | SEQ ID # | Target gene | TALEN (Left and Right heterodimers) | TALEN Polypeptide Sequence |
|---|---|---|---|---|
| | | | | GGGKQALETVQRLLPVLCQAHGLTPQQVVAIASNGGGRPALESIVAQLSRPDPALAALT NDHLVALACLGGRPALDAVKKGLGDPISRSQLVKSEEEKKSELRHKLKVPHEYIELIEI ARNSTQDRILEMKVMEFFMKVYGYRGKHLGGSRKPDGAIYTVGSPIDYGVIVDTKAYSG GYNLPIGQADEMQRYVEENQTRNKHINPNEWWKVYPSSVTEFKFLFVSGHFKGNYKAQ LTRLNHITNCNGAVLSVEELLIGGEMIKAGTLTLEEVRRKFNNGEINFAAD |
| pCLS29701 | 44 | BCAT1 (exon4) | bcat1_ex4-R1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNNGGKQ ALETVQRLLPVLCQAHGLTPEQVVAIASNIGGKQALETVQALLPVLCQAHGLTPQQVVAI ASNGGKQALETVQRLLPVLCQAHGLTPEQVVAIASHDGGKQALETVQRLLPVLCQAH LLPVLCQAHGLTPEQVVAIASHDGGKQALETVQRLLPVLCQAHGLTPQQVVAIASNGGG KQALETVQRLLPVLCQAHGLTPEQVVAIASHDGGKQALETVQRLLPVLCQAHGLTPEQV VAIASHDGGKQALETVQRLLPVLCQAHGLTPQQVVAIASNGGGKQALETVQRLLPVLCQ AHGLTPEQVVAIASHDGGKQALETVQRLLPVLCQAHGLTPQQVVAIASNNGGKQALETV QRLLPVLCQAHGLTPEQVVAIASNIGGKQALETVQLLPVLCQAHGLTPEQVVAIASNIG GKQALETVQALLPVLCQAHGLTPQQVVAIASNGGGRPALESIVAQLSRPDPALAALTND HLVALACLGGRPALDAVKKGLGDPISRSQLVKSEEEKKSELRHKLKVPHEYIELIEIAR NSTQDRILEMKVMEFFMKVYGYRGKHLGGSRKPDGAIYTVGSPIDYGVIVDTKAYSGGY NLPIGQADEMQRYVEENQTRNKHINPNEWWKVYPSSVTEFKFLFVSGHFKGNYKAQLT RLNHITNCNGAVLSVEELLIGGEMIKAGTLTLEEVRRKFNNGEINFAAD |
| pCLS27579 | 45 | DNMT3A | DNMT3A-L1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNNGGKQA LETVQRLLPVLCQAHGLTPQQVVAIASNIGGKQALETVQRLLPVLCQAHGLIPEQVVAI ASNIGGKQALETVQALLPVLCQAHGLTPQQVVAIASNNGGKQALETVQRLLPVLCQAHG LTPQQVVAIASNNGGKQALETVQRLLPVLCQAHGLTPQQVVAIASNIGGKQALETVQALL PVLCQAHGLTPQQVVAIASNNGGKQALETVQRLLPVLCQAHGLTPQQVVAIASNGGGKQ ALETVQRLLPVLCQAHGLTPEQVVAIASNNGGKQALETVQRLLPVLCQAHGLTPQQVVA IASNGGGKQALETVQRLLPVLCQAHGLTPQQVVAIASNNGGKQALETVQRLLPVLCQAH GLTPEQVVAIASHDGGKQALETVQRLLPVLCQAHGLTPQQVVAIASHDGGKQALETVQR LLPVLCQAHGLTPEQVVAIASNGGGKQALETVQALLPVLCQAHGLTPEQVVAIASNIGGK QALETVQALLPVLCQAHGLTPQQVVAIASNGGGRPALESIVAQLSRPDPALAALTNDHLV ALACLGGRPALDAVKKGLGDPISRSQLVKSEEEKKSELRHKLKVPHEYIELIEIARNST QDRILEMKVMEFFMKVYGYRGKHLGGSRKPDGAIYTVGSPIDYGVIVDTKAYSGGYNLP IGQADEMQRYVEENQTRNKHINPNEWWKVYPSSVTEFKFLFVSGHFKGNYKAQLTRLN HITNCNGAVLSVEELLIGGEMIKAGTLTLEEVRRKFNNGEINFAAD |
| pCLS27581 | 46 | DNMT3A | DNMT3A-L2 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNNGGKQA LETVQRLLPVLCQAHGLTPQQVVAIASNIGGKQALETVQALLPVLCQAHGLTPQQVVAI ASNNGGKQALETVQRLLPVLCQAHGLTPQQVVAIASNGGGKQALETVQ RLLPVLCQAHGLIPEQVVAIASNIGGKQALETVQRLLPVLCQAHGLTPEQVVAIASNIGG |

TABLE 3-continued

Polypeptide sequences of TALEN-reagents used in the examples

| Nickname | SEQ ID # | Target gene | TALEN (Left and Right heterodimers) | TALEN Polypeptide Sequence |
|---|---|---|---|---|
| | | | | KQALETVQALLPVLCQAHGLTPEQVVAIASHDGGKQALETVQRLLPVLCQ VAIASHDGGKQALETVQRLLPVLCQAHGLTPQQVVAIASNGGGKQALETVQRLLPVLCQ AHGLTPQQVVAIASNNGGKQALETVQRLLPVLCQAHGLTPEQVVAIASNIGGKQALETV QALLPVLCQAHGLTPQQVVAIASNNGGKQALETVQRLLPVLCQAHGLTPQQVVAIASNN GGKQALETVQRLLPVLCQAHGLTPQQVVAIASNNGGRPALESIVAQLSRPDPALAALTN DHVALACLGGRPALDAVKKGLGDPISRSQLVKSELEEKKSELRHKLKYVPHEYIELIEIA RNSTQDRILEMKVMEFFMKVYGYRGKHLGGSRKPDGAIYTVGSPIDYGVIVDTKAYSGG YNLPIGQADEMQRYVEENQTRNKHINPNEWWKVYPSSVTEFKFLFVSGHFKGNYKAQL TRLNHITNCNGAVLSVEELLIGGEMIKAGTLTLEEVRRKFNNGEINFAAD |
| pCLS27580 | 47 | DNMT3A | DNMT3A-R1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPEQVVAIASHDGGKQA LETVQRLLPVLCQAHGLTPQQVVAIASNGGGKQALETVQRLLPVLCQAHGLTPEQVVAI ASHDGGKQALETVQRLLPVLCQAHGLTPEQVVAIASHDGGKQALETVQRLLPVLCQAH GLTPQQVVAIASNGGGKQALETVQRLLPVLCQAHGLTPQQVVAIASNNGGKQALETVQ RLLPVLCQAHGLTPQQVVAIASNNGGKQALETVQRLLPVLCQAHGLTPQQVVAIASNNG GKQALETVQRLLPVLCQAHGLTPQQVVAIASNNGGKQALETVQRLLPVLCQAHGLTPQ QVVAIASNNGGKQALETVQRLLPVLCQAHGLTPQQVVAIASNNGKQALETVQRLLPVL CQAHGLTPQQVVAIASNNGGKQALETVQRLLPVLCQAHGLTPQQVVAIASNGGGKQAL ETVQRLLPVLCQAHGLTPQQVVAIASNNGGKQALETVQRLLPVLCQAHGLTPQQVVAIA SNGGGKQALETVQRLLPVLCQAHGLTPQQVVAIASNGGGRPALESIVAQLSRPDPALAA LTNDHLVALACLGGRPALDAVKKGLGDPISRSQLVKSELEEKKSELRHKLKYVPHEYIELI EIARNSTQDRILEMKVMEFFMKVYGYRGKHLGGSRKPDGAIYTVGSPIDYGVIVDTKAYS GGYNLPIGQADEMQRYVEENQTRNKHINPNEWWKVYPSSVTEFKFLFVSGHFKGNYKA QLTRLNHITNCNGAVLSVEELLIGGEMIKAGTLTLEEVRRKFNNGEINFAAD |
| pCLS27582 | 48 | DNMT3A | DNMT3A-R2 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNGGGKQ ALETVQRLLPVLCQAHGLTPQQVVAIASNGGGKQALETVQRLLPVLCQAHGLTPQQVVA IASNGGGKQALETVQRLLPVLCQAHGLTPQQVVAIASNNGGKQALETVQRLLPVLCQAH GLTPQQVVAIASNGGGKQALETVQRLLPVLCQAHGLTPEQVVAIASHDGGKQALETVQR LLPVLCQAHGLTPQQVVAIASNNGGKQALETVQRLLPVLCQAHGLTPQQVVAIASNGG KQALETVQRLLPVLCQAHGLTPQQVVAIASNNGGKQALETVQRLLPVLCQAHGLTPQQ VVAIASNGGGKQALETVQRLLPVLCQAHGLTPQQVVAIASNNGGKQALETVQRLLPVLC QAHGLTPQQVVAIASNNGGKQALETVQRLLPVLCQAHGLTPQQVVAIASNIGGKQALET VQALLPVLCQAHGLTPQQVVAIASNNGGKQALETVQRLLPVLCQAHGLTPQQVVAIASN NGGKQALETVQRLLPVLCQAHGLTPQQVVAIASNGGGRPALESIVAQLSRPDPALAALT NDHLVALACLGGRPALDAVKKGLGDPISRSQLVKSELEEKKSELRHKLKYVPHEYIELIEI ARNSTQDRILEMKVMEFFMKVYGYRGKHLGGSRKPDGAIYTVGSPIDYGVIVDTKAYSG GYNLPIGQADEMQRYVEENQTRNKHINPNEWWKVYPSSVTEFKFLFVSGHFKGNYKAQ LTRLNHITNCNGAVLSVEELLIGGEMIKAGTLTLEEVRRKFNNGEINFAAD |
| pCLS30121 | 49 | IL27RA (exon 1) | IL27RAex1-L1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNNGGKQA |

TABLE 3-continued

Polypeptide sequences of TALEN-reagents used in the examples

| Nickname | SEQ ID # | Target gene | TALEN (Left and Right heterodimers) | TALEN Polypeptide Sequence |
|---|---|---|---|---|
| | | | | LETVQRLLPVLCQAHGLTPQQVVAIASNGGGKQALETVQRLLPVLCQAHGLTPQQVVAI ASNNGGKQALETVQRLLPVLCQAHGLTPQQVVAIASNNGGKQALETVQRLLPVLCQAH GLTPQQVVAIASNNGGKQALETVQRLLPVLCQAHGLTPQQVVAIASNGGGKQALETVQ RLLPVLCQAHGLTPQQVVAIASNNGGKQALETVQRLLPVLCQAHGLTPEQVVAIASHDG GKQALETVQRLLPVLCQAHGLTPQQVVAIASNGGGKQALETVQRLLPVLCQAHGLTPQ QVVAIASNGGGKQALETVQRLLPVLCQAHGLTPQQVVAIASNGGGKQALETVQRLLPVL CQAHGLTPQQVVAIASNGGGKQALETVQRLLPVLCQAHGLTPEQVVAIASHDGGKQAL ETVQRLLPVLCQAHGLTPEQVVAIASHDGGKQALETVQRLLPVLCQAHGLTPEQVVAIA SNIGGKQALETVQALLPVLCQAHGLTPQQVVAIASNGGGRPALESIVAQLSRPDPALAAL TNDHLVALACLGGRPALDAVKKGLGDPISRSQLVKSELEEKKSELRHKLKVPHEYIELIE IARNSTQDRILEMKVMEFFMKVYGRGKHLGGSRKPDGAIYTVGSPIDYGVIVDTKAYS GYNLPIGQADEMQRYVEENQTRNKHINPNEWWKVYPSSVTEFKFLFVSGHFKGNYKA QLTRLNHITNCNGAVLSVEELLIGGEMIKAGTLTLEEVRRKFNNGEINFAAD |
| pCLS30122 | 50 | IL27RA (exon 1) | IL27RAex1-R1 | MGDPKKKRKVIDYPYDVPDYAIDIADLRTLGYSQQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPEQVVAIASHDGGKQA LETVQRLLPVLCQAHGLTPEQVVAIASHDGGKQALETVQRLLPVLCQAHGLTPEQVVAIA SHDGGKQALETVQRLLPVLCQAHGLTPQQVVAIASNGGGKQALETVQRLLPVLCQAHG LTPEQVVAIASHDGGKQALETVQRLLPVLCQAHGLTPQQVVAIASHDGGKQALETVQRL LPVLCQAHGLTPEQVVAIASNIGGKQALETVQALLPVLCQAHGLTPQQVVAIASNNGGK QALETVQRLLPVLCQAHGLTPEQVVAIASHDGGKQALETVQRLLPVLCQAHGLTPEQVV AIASNIGGKQALETVQALLPVLCQAHGLTPEQVVAIASHDGGKQALETVQRLLPVLCQAH GLTPQQVVAIASNGGGKQALETVQRLLPVLCQAHGLTPEQVVAIASHDGGKQALETVQ RLLPVLCQAHGLTPEQVVAIASNIGGKQALETVQALLPVLCQAHGLTPEQVVAIASHDGG KQALETVQRLLPVLCQAHGLTPQQVVAIASNGGGRPALESIVAQLSRPDPALAALTNDH LVALACLGGRPALDAVKKGLGDPISRSQLVKSELEKKKSELRHKLKVPHEYIELIEIARN STQDRILEMKVMEFFMKVYGYRGKHLGGSRKPDGAIYTVGSPIDYGVIVDTKAYSGGYN LPIGQADEMQRYVEENQTRNKHINPNEWWKVYPSSVTEFKFLFVSGHFKGNYKAQLTR LNHITNCNGAVLSVEELLIGGEMIKAGTLTLEEVRRKFNNGEINFAAD |
| pCLS30123 | 51 | IL27RA (exon 2) | IL27RAex2-L1 | MGDPKKKRKVIDYPYDVPDYAIDIADLRTLGYSQQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNGGGKQ ALETVQRLLPVLCQAHGLTPQQVVAIASNNGGKQALETVQRLLPVLCQAHGLTPQQVVA IASNNGGKQALETVQRLLPVLCQAHGLTPQQVVAIASNNGGKQALETVQRLLPVLCQAH GLTPQQVVAIASNGGGKQALETVQRLLPVLCQAHGLTPEQVVAIASHDGGKQALETVQA LLPVLCQAHGLTPQQVVAIASNGGGKQALETVQRLLPVLCQAHGLTPEQVVAIASHDGG KQALETVQRLLPVLCQAHGLTPQQVVAIASNNGGKQALETVQRLLPVLCQAHGLTPQQ VVAIASNNGGKQALETVQRLLPVLCQAHGLTPQQVVAIASNNGGKQALETVQRLLPVLC QAHGLTPQQVVAIASNNGGKQALETVQRLLPVLCQAHGLTPEQVVAIASNIGGKQALET VQALLPVLCQAHGLTPQQVVAIASNNGGKQALETVQRLLPVLCQAHGLTPEQVVAIASH DGGKQALETVQRLLPVLCQAHGLTPQQVVAIASNGGGRPALESIVAQLSRPDPALAALT NDHLVALACLGGRPALDAVKKGLGDPISRSQLVKSELEEKKSELRHKLKVPHEYIELIEI ARNSTQDRILEMKVMEFFMKVYGRGKHLGGSRKPDGAIYTVGSPIDYGVIVDTKAYSG GYNLPIGQADEMQRYVEENQTRNKHINPNEWWKVYPSSVTEFKFLFVSGHFKGNYKAQ LTRLNHITNCNGAVLSVEELLIGGEMIKAGILTLEEVRRKFNNGEINFAAD |

TABLE 3-continued

Polypeptide sequences of TALEN-reagents used in the examples

| Nickname | SEQ ID # | Target gene | TALEN (Left and Right heterodimers) | TALEN Polypeptide Sequence |
|---|---|---|---|---|
| pCLS30124 | 52 | IL27RA (exon 2) | IL27RAex2-R1 | MGDPKKKRKVIDYPDYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPEQVVAIASNIGGKQAL ETVQALLPVLCQAHGLTPEQVVAIASHDGGKQALETVQRLLPVLCQAHGLTPQQVVAIA SNGGGKQALETVQRLLPVLCQAHGLTPQQVVAIASNGGGKQALETVQRLLPVLCQAHG LTPQQVVAIASNGGGKQALETVQRLLPVLCQAHGLTPQQVVAIASNGGGKQALETVQRL LPVLCQAHGLTPQQVVAIASHDGGKQALETVQRLLPVLCQAHGLTPQQVVAIASNNGGK QALETVQRLLPVLCQAHGLTPEQVVAIASHDGGKQALETVQRLLPVLCQAHGLTPQQVV AIASNGGGKQALETVQRLLPVLCQAHGLTPQQVVAIASHDGGKQALETVQRLLPVLCQA HGLTPQQVVAIASNGGGKQALETVQRLLPVLCQAHGLTPQQVVAIASNNGGKQALETV QRLLPVLCQAHGLTPQQVVAIASNGGGKQALETVQRLLPVLCQAHGLTPEQVVAIASNI GGKQALETVQALLPVLCQAHGLTPQQVVAIASNGGGRPALESIVAQLSRPDPALAALTN DHLVALACLGGRPALDAVKKGLGDPISRSQLVKSELEEKKSELRHKLKYVPHEYIELIEIA RNSTQDRILEMKVMEFFMKVYGYRGKHLGGSRKPDGAIYTVGSPIDYGVIVDTKAYSGG YNLPIQADEMQRYVEENQTRNKHINPNEWKVYPSSVTEFKFLFVSGHFKGNYKAQL TRLNHITNCNGAVLSVEELLIGGEMIKAGTLTLEEVRRKFNNGEINFAAD |
| pCLS30125 | 53 | IL27RA (exon 5) | IL27RAex5_1-L1 | MGDPKKKRKVIDYPDYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPEQVVAIASNIGGKQAL ETVQALLPVLCQAHGLTPEQVVAIASNGGGKQALETVQRLLPVLCQAHGLTPQQVVAIA SHDGGKCALETVQRLLPVLCQAHGLTPEQVVAIASHDGGKQALETVQRLLPVLCQAHG LTPEQVVAIASHDGGKQALETVQRLLPVLCQAHGLTPQQVVAIASNGGGKQALETVQRL LPVLCQAHGLTPQQVVALLPVLCQAHGLTPQQVVAIASHDGGKQALETVQRLLPVLCQAHGLTPEQVV AIASHDGGKQALETVQRLLPVLCQAHGLIPEQVVAIASNGGGKQALETVQRLLPVLCQA HGLTPEQVVAIASHDGGKQALETVQRLLPVLCQAHGLTPQQVVAIASNGGGKQALETV QRLLPVLCQAHGLTPQQVVAIASNGGGKQALETVQRLLPVLCQAHGLTPQQVVAIASNG GGKQALETVQRLLPVLCQAHGLTPQQVVAIASNGGGRPALESIVAQLSRPDPALAALTN DHLVALACLGGRPALDAVKKGLGDPISRSQLVKSELEEKKSELRHKLKYVPHEYIELIEIA RNSTQDRILEMKVMEFFMKVYGYRGKHLGGSRKPDGAIYTVGSPIDYGVIVDTKAYSGG YNLPIQADEMQRYVEENQTRNKHINPNEWKVYPSSVTEFKFLFVSGHFKGNYKAQL TRLNHITNCNGAVLSVEELLIGGEMIKAGTLTLEEVRRKFNNGEINFAAD |
| pCLS30126 | 54 | IL27RA (exon 5) | IL27RAex5_1-R1 | MGDPKKKRKVIDYPDYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPEQVVAIASNIGGKQAL ETVQALLPVLCQAHGLTPEQVVAIASNGGGKQALETVQRLLPVLCQAHGLTPQQVVAIA SHDGGKQALETVQRLLPVLCQAHGLTPEQVVAIASHDGGKQALETVQRLLPVLCQAHG LTPEQVVAISNIGGKQALIPEQVVAIASNGGGKQALETVQRLLPVLCQAHGLTPQQVVAIA PVLCQAHGLTPQQVVAIASNGGGKQALETVQRLLPVLCQAHGLTPQQVVAIASNNGGK QALETVQRLLPVLCQAHGLTPQQVVAIASNGGGKQALETVQRLLPVLCQAHGLTPQVV AIASHDGGKQALETVQRLLPVLCQAHGLTPQQVVAIASNGGGKQALETVQRLLPVLCQA RLLPVLCQAHGLIPEQVVAIASNIGGKQALETVQRLLPVLCQAHGLTPQQVVAIASNGG GKQALETVQRLLPVLCQAHGLTPQQVVAIASNGGGRPALESIVAQLSRPDPALAALTND |

TABLE 3-continued

Polypeptide sequences of TALEN-reagents used in the examples

| Nickname | SEQ ID # | Target gene | TALEN (Left and Right heterodimers) | TALEN Polypeptide Sequence |
|---|---|---|---|---|
| pCLS30127 | 55 | IL27RA (exon 5) | IL27RAex5_2-L1 | HLVALACLGGRPALDAVKKGLGDPISRSQLVKSELEEKKSELRHKLKYVPHEYIELIEIAR NSTQDRILEMKVMEFFMKVYGYRGKHLGGSRKPDGAIYTVGSPIDYGVIVDTKAYSGGY NLPIGQADEMQRYVEENQTRNKHINPNEWWKVYPSSVTEFKFLFVSGHFKGNYKAQLT RLNHITNCNGAVLSVEELLIGGEMIKAGTLTLEEVRRKFNNGEINFAAD |
| pCLS30128 | 56 | IL27RA (exon 5) | IL27RAex5_2-R1 | MGDPKKKRKVIDYPVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNNGGKQA LETVQRLLPVLCQAHGLTPQQVVAIASNNGGKQALETVQRLLPVLCQAHGLTPQQVVAI ASNNGGKQALETVQRLLPVLCQAHGLTPQQVVAIASHDGGKQALETVQRLLPVLCQAH GLTPQQVVAIASNGGKQALETVQRLLPVLCQAHGLTPQQVVAIASNGGKQALETVQ RLLPVLCQAHGLTPQQVVAIASHDGGKQALETVQRLLPVLCQAHGLTPEQVVAIASHDG GKQALETVQRLLPVLCQAHGLTPEQVVAIASHDGGKQALETVQRLLPVLCQAHGLTPEQ VVAIASHDGGKQALETVQRLLPVLCQAHGLTPQQVVAIASNGGKQALETVQRLLPVLC QAHGLTPEQVVAIASHDGGKQALETVQRLLPVLCQAHGLTPEQVVAIASNIGGKQALET VQALLPVLCQAHGLTPQQVVAIASNGGKQALETVQALLPVLCQAHGLTPQQVVAIASNG GGKQALETVQRLLPVLCQAHGLTPQQVVAIASNGGRPALESIVAQLSRPDPALAALTN DHLVALACLGGRPALDAVKKGLGDPISRSQLVKSELEEKKSELRHKLKYVPHEYIELIEIA RNSTQDRILEMKVMEFFMKVYGYRGKHLGGSRKPDGAIYTVGSPIDYGVIVDTKAYSGG YNLPIGQADEMQRYVEENQTRNKHINPNEWWKVYPSSVTEFKFLFVSGHFKGNYKAQL TRLNHITNCNGAVLSVEELLIGGEMIKAGTLTLEEVRRKFNNGEINFAAD |
| pCLS29706 | 57 | PEA-15 (Exon1) | PEA-15_ex1-L1 | MGDPKKKRKVIDYPVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNNGGKQA LETVQRLLPVLCQAHGLTPQQVVAIASNNGGKQALETVQRLLPVLCQAHGLTPQQVVA ALETVQRLLPVLCQAHGLTPQQVVAIASNNGGKQALETVQRLLPVLCQAHGLTPQQVVA IASNNGGKQALETVQRLLPVLCQAHGLTPQQVVAIASNIGGKQALETVQALLPVLCQAHG LTPEQVVAIASHDGGKQALETVQRLLPVLCQAHGLTPQQVVAIASNIGGKQALETVQALL PVLCQAHGLTPQQVVAIASNNGGKQALETVQRLLPVLCQAHGLTPQQVVAIASNIGGKQ ALETVQALLPVLCQAHGLTPEQVVAIASHDGGKQALETVQRLLPVLCQAHGLTPQQVVA IASNGGGKQALETVQRLLPVLCQAHGLTPQQVVAIASNGGKQALETVQRLLPVLCQAH GLTPEQVVAIASHDGGKQALETVQRLLPVLCQAHGLTPQQVVAIASNGGKQALETVQ RLLPVLCQAHGLTPQQVVAIASHDGGKQALETVQRLLPVLCQAHGLTPEQVVAIASNNG GKQALETVQRLLPVLCQAHGLTPQQVVAIASNGGRPALESIVAQLSRPDPALAALTND HLVALACLGGRPALDAVKKGLGDPISRSQLVKSELEEKKSELRHKLKYVPHEYIELIEIAR NSTQDRILEMKVMEFFMKVYGYRGKHLGGSRKPDGAIYTVGSPIDYGVIVDTKAYSGGY NLPIGQADEMQRYVEENQTRNKHINPNEWWKVYPSSVTEFKFLFVSGHFKGNYKAQLT RLNHITNCNGAVLSVEELLIGGEMIKAGTLTLEEVRRKFNNGEINFAAD |
| | | | | MGDPKKKRKVIDYPVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNNGGKQA LETVQRLLPVLCQAHGLTPQQVVAIASHDGGKQALETVQALLPVLCQAHGLTPEQVVAIA SNIGGKQALETVQALLPVLCQAHCLIPEQVVAIASNIGGKQALETVQALLPV LCQAHGLTPEQVVAIASHDGGKQALETVQRLLPVLCQAHGLTPEQVVAIASHDGGKQAL ETVQRLLPVLCQAHGLTPQQVVAIASNGGKQALETVQRLLPVLCQAHGLTPQQVVAIA |

TABLE 3-continued

Polypeptide sequences of TALEN-reagents used in the examples

| Nickname | SEQ ID # | Target gene | TALEN (Left and Right heterodimers) | TALEN Polypeptide Sequence |
|---|---|---|---|---|
| pCLS29707 | 58 | PEA-15 (Exon1) | PEA-15_ex1-R1 | SNNGGKQALETVQRLLPVLCQAHGLTPEQVVAIASNIGGKQALETVQALLPVLCQAHGL TPEQVVAIASHDGGKQALETVQRLLPVLCQAHGLTPEQVVAIASNIGGKQALETVQRLL PVLCQAHGLTPEQVVAIASNIGGKQALETVQALLPVLCQAHGLTPEQVVAIASNIGGKQA LETVQALLPVLCQAHGLTPQQVVAIASNGGGRPALESIVAQLSRPDPALAALTNDHLVAL ACLGGRPALDAVKKGLGDPISRSQLVKSELEEKKSELRHKLKYVPHEYIELEIARNSTQD RILEMKVMEFFMKVYGYRGKHLGGSRKPDGAIYTVGSPIDYGVIVDTKAYSGGYNLPIG QADEMQRYVEENQTRNKHINPNEWWKVYPSSVTEFKFLFVSGHFKGNYKAQLTRLNHI TNCNGAVLSVEELLIGGEMIKAGTLTLEEVRRKFNNGEINFAAD |
| pCLS29708 | 59 | PEA-15 (Exon2) | PEA-15_ex2-L1 | MGDPKKKRKVIDYPYDVPDYAIDIADLRTLGYSQQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNGGGKQ ALETVQRLLPVLCQAHGLTPQQVVAIASNNGGKQALETVQRLLPVLCQAHGLTPEQVVA IASNIGGKQALETVQALLPVLCQAHGLTPQQVVAIASNNGGKQALETVQRLLPVLCQAH GLTPEQVVAIASHDGKQALETVQRLLPVLCQAHGLTPQQVVAIASNGGGKQALETVQ RLLPVLCQAHGLTPQQVVAIASNGGKQALETVQRLLPVLCQAHGLTPE QVVAIASHDGGKQALETVQRLLPVLCQAHGLTPQQVVAIASNGGKQALETVQRLLPVL CQAHGLTPEQVVAIASNIGGKQALETVQALLPVLCQAHGLTPQQVVAIASNNGGKQALE TVQRLLPVLCQAHGLTPQQVVAIASNIGGKQALETVQALLPVLCQAHGLTPQQVVAIASN GGGKQALETVQRLLPVLCQAHGLTPQQVVAIASNGGGRPALESIVAQLSRPDPALAALT NDHLVALACLGGRPALDAVKKGLGDPISRSQLVKSELEEKKSELRHKLKYVPHEYIELEI ARNSTQDRILEMKVMEFFMKVYGYRGKHLGGSRKPDGAIYTVGSPIDYGVIVDTKAYSG GYNLPIGQADEMQRYVEENQTRNKHINPNEWWKVYPSSVTEFKFLFVSGHFKGNYKAQ LTRLNHITNCNGAVLSVEELLIGGEMIKAGTLTLEEVRRKFNNGEINFAAD |
| pCLS29709 | 60 | PEA-15 (Exon2) | PEA-15_ex2-R1 | MGDPKKKRKVIDYPYDVPDYAIDIADLRTLGYSQQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASHDGGKQA LETVQRLLPVLCQAHGLTPEQVVAI |

TABLE 3-continued

Polypeptide sequences of TALEN-reagents used in the examples

| Nickname | SEQ ID # | Target gene | TALEN (Left and Right heterodimers) | TALEN Polypeptide Sequence |
|---|---|---|---|---|
| | | | | ASHDCCKQALETVQRLLPVLCQAHGLTPEQVVAIASNIGGKQALETVQALLPVLCQAHG LTPEQVVAIASNIGGKQALETVQALLPVLCQAHGLTPEQVVAIASNIGGKQALETVQALLP VLCQAHGLTPQQVVAIASNNGGKQALETVQRLLPVLCQAHGLTPEQVVAIASNIGGKQA LETVQALLPVLCQAHGLTPEQVVAIASHDGGKQALETVQRLLPVLCQAHGLTPQQVVAI ASNNGGKQALETVQRLLPVLCQAHGLTPQQVVAIASNGGKQALETVQRLLPVLCQAH GLTPQQVVAIASNNGGKQALETVQRLLPVLCQAHGLTPEQVVAIASHDGGKQALETVQR LLPVLCQAHGLTPQQVVAIASNGGGKQALETVQRLLPVLCQAHGLTPEQVVAIASHDGG KQALETVQRLLPVLCQAHGLTPQQVVAIASNGGGRPALESIVAQLSRPDPALAALTNDH LVALACLGGRPALDAVKKGLGDPISRSQLVKSELEEKKSELRHKLKYVPHEYIELIEIARN STQDRIILEMKVMEFFMKVYGRKHLGGSRKPDGAIYTVGSPIDYGVIVDTKAYSGGYN LPIGQADEMQRYVEENQTRNKHINPNEWWKVYPSSVTEFKFLFVSGHFKGNYKAQLTR LNHITNCNGAVLSVEELLIGGEMIKAGTLTLEEVRRKFNNGEINFAAD |
| pCLS29710 | 61 | SEMA7A | Sema7a_1-L1 | MGDPKKKRKVIDYPYDVPDYAIDIADLRTLGYSQQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNNGGKQA LETVQRLLPVLCQAHGLTPEQVVAIASHDGGKQALETVQRLLPVLCQAHGLTPQQVVAI ASNNGGKQALETVQRLLPVLCQAHGLTPQQVVAIASNGGKQALETVQRLLPVLCQAH GLTPEQVVAIASHDGGKQALETVQRLLPVLCQAHGLTPQQVVAIASNGGGKQALETVQ RLLPVLCQAHGLTPQQVVAIASNNGGKQALETVQRLLPVLCQAHGLTPEQVVAIASHDG GKQALETVQRLLPVLCQAHGLTPQQVVAIASNGGKQALETVQRLLPVLCQAHGLTPQ QVVAIASNNGGKQALETVQRLLPVLCQAHGLTPEQVVAIASHDGGKQALETVQRLLPVL CQAHGLTPQQVVAIASNGGGKQALETVQRLLPVLCQAHGLTPQQVVAIASNNGGKQAL ETVQRLLPVLCQAHGLTPEQVVAIASNGGGRPALESIVAQLSRPDPALAA SNGGGKQALETVQRLLPVLCQAHGLTPQQVVAIASNGGGRPALESIVAQLSRPDPALAA LTNDHLVALACLGGRPALDAVKKGLGDPISRSQLVKSELEKKSELRHKLKYVPHEYIELI EIARNSTQDRILEMKVMEFFMKVYGYRGKHLGGSRKPDGAIYTVGSPIDYGVIVDTKAYS GGYNLPIGQADEMQRYVEENQTRNKHINPNEWWKVYPSSVTEFKFLFVSGHFNNGEINFAAD QLTRLNHITNCNGAVLSVEELLIGGEMIKAGTLTLEEVRRKFNNGEINFAAD |
| pCLS29711 | 62 | SEMA7A | Sema7a_1-R1 | MGDPKKKRKVIDYPYDVPDYAIDIADLRTLGYSQQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNNGGKQA LETVQRLLPVLCQAHGLTPQQVVAIASNNGGKQALETVQRLLPVLCQAHGLTPEQWAI ASHDGGKQALETVQRLLPVLCQAHGLTPEQVVAIASHDGGKQALETVQRLLPVLCQAH GLTPEQVVAIASNNGGKQALETVQRLLPVLCQAHGLTPQQVVAIASNGGKQALETVQ RLLPVLCQAHGLTPQQVVAIASNGGKQALETVQRLLPVLCQAHGLTPEQVVAIASNNG GKQALETVQRLLPVLCQAHGLTPQQWAIASNNGGKQALETVQRLLPVLCQAHGLIPE QVVAIASHDGGKQALETVQRLLPVLCQAHGLTPQQVVAIASNNGGKQALETVQRLLPVL CQAHGLTPQQVVAIASNNGGKQALETVQRLLPVLCQAHGLTPEQVVAIASNIGGKQALE TVQAALLPVLCQAHGLTPQQVVAIASNGGKQALETVQRLLPVLCQAHGLTPQQVVAIAS NNGGKQALETVQRLLPVLCQAHGLTPQQVVAIASNGGGRPALESIVAQLSRPDPALAAL TNDHLVALACLGGRPALDAVKKGLGDPISRSQLVKSELEKKSELRHKLKVPHEYIELIE IARNSTQDRILEMKVMEFFMKVYGRKHLNPNEWWKVYPSSVTEFKFLFVSGHFKGNYKA GGYNLPIGQADEMQRYVEENQTRNKHINPNEWWKVYPSSVTEFKFLFVSGHFKGNYKA QLTRLNHITNCNGAVLSVEELLIGGEMIKAGTLTLEEVRRKFNNGEINFAAD |

TABLE 3-continued

Polypeptide sequences of TALEN-reagents used in the examples

| Nickname | SEQ ID # | Target gene | TALEN (Left and Right heterodimers) | TALEN Polypeptide Sequence |
|---|---|---|---|---|
| pCLS29712 | 63 | SEMA7A (Exon2) | Sema7a_ex2-L1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGVTAVEAVHAWRNALTGAPLNLTPQQVVAIASNGGGKQ ALETVQRLLPVLCQAHGLTPQQVVAIASNNGGKQALETVQRLLPVLCQAHGLTPQQVVA IASNGGGKQALETVQRLLPVLCQAHGLTPEQVVAIASHDGGKQALETVQRLLPVLCQAH GLTPQQVVAIASNGGKQALETVQRLLPVLCQAHGLTPEQVVAIASHDGGKQALETVQ RLLPVLCQAHGLIPEQVVAIASHDGGKQALETVQRLLPVLCQAHGLTPQQVVAIASNGG GKQALETVQRLLPVLCQAHGLTPEQVVAIASHDGGKQALETVQRLLPVLCQAHGLTPEQ VVAIASHDGGKQALETVQRLLPVLCQAHGLTPQQVVAIASNGGGKQALETVQRLLPVLC QAHGLIPEQVVAIASHDGGKQALETVQRLLPVLCQAHGLTPEQVVAIASNIGGKQALET VQALLPVLCQAHGLTPQQVVAIASNNGGKQALETVQRLLPVLCQAHGLTPQQVVAIASN NGGKQALETVQRLLPVLCQAHGLTPQQVVAIASNGGGRPALESIVAQLSRPDPALAALT NDHLVALACLGGRPALDAVKKGLGDPISRSQLVKSELEEKKSELRHKLKYVPHEYIELIEI ARNSTQDRILEMKVMEFFMKVYGYRGKHLGGSRKPDGAIYTVGSPIDYGVIVDTKAYSG GYNLPIGQADEMQRYVEENQTRNKHINPNEWWKVYPSSVTEFKFLFVSGHFKGNYKAQ LTRLNHITNCNGAVLSVEELLIGGEMIKAGTLTLEEVRRKFNNGEINFAAD |
| pCLS29713 | 64 | SEMA7A (Exon2) | Sema7a_ex2-R1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGVTAVEAVHAWRNALTGAPLNLTPQQVVAIASNNGGKQA LETVQRLLPVLCQAHGLTPQQVVAIASNNGGKQALETVQRLLPVLCQAHGLTPEQVVAI ASHDGGKQALETVQRLLPVLCQAHGLTPEQVVAIASHDGGKQALETVQRLLPVLCQAH GLTPEQVVAIASNIGGKQALETVQALLPVLCQAHGLTPEQVVAIASNIGGKQALETVQALL PVLCQAHGLIPEQVVAIASNIGGKQALETVQALLPVLCQAHGLTPQQVVAIASNNGGKQ ALETVQRLLPVLCQAHGLTPQQVVAIASNNGGKQALETVQRLLPVLCQAHGLTPEQVVA IASHDGGKQALETVQRLLPVLCQAHGLTPEQVVAIASHDGGKQALETVQRLLPVLCQAH GLTPEQVVAIASNIGGKQALETVQALLPVLCQAHGLTPEQVVAIASHDGGKQALETVQRL LPVLCQAHGLTPEQVVAIASHDGGKCIALETVQRLLPVLCQAHGLTPEQVVAIASHDGGK QALETVQRLLPVLCQAHGLTPQQVVAIASNGGGRPALESIVAQLSRPDPALAALTNDHL VALACLGGRPALDAVKKGLGDPISRSQLVKSELEEKKSELRHKLKYVPHEYIELIEIARNS TQDRILEMKVMEFFMKVYGYRGKHLGGSRKPDGAIYTVGSPIDYGVIVDTKAYSGGYNL PIGQADEMQRYVEENQTRNKHINPNEWWKVYPSSVTEFKFLFVSGHFKGNYKAQLTRL NHITNCNGAVLSVEELLIGGEMIKAGTLTLEEVRRKFNNGEINFAAD |
| pCLS29714 | 65 | SHARPIN (Exon2) | Sharpin_ex2_1-L1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGVTAVEAVHAWRNALTGAPLNLTPEQVVAIASHDGGKQA LETVQRLLPVLCQAHGLTPQQVVAIASNGGGKQALETVQRLLPVLCQAHGLTPQQVVAI ASNGGGKQALETVQRLLPVLCQAHGLTPEQVVAIASHDGGKQALETVQRLLPVLCQAH GLTPQQVVAIASNGGGKQALETVQRLLPVLCQAHGLTPEQVVAIASHDGGKQALETVQ RLLPVLCQAHGLTPEQVVAIASNIGGKQALETVQRLLPVLCQAHGLTPQQVVAIASNNGG KQALETVQRLLPVLCQAHGLTPQQVVAIASNNGGKQALETVQRLLPVLCQAHGLTPQQ VVAIASNGGGKQALETVQRLLPVLCQAHGLTPQQVVAIASNNGGKQALETVQRLLPVLC QAHGLTPEQVVAIASNIGGKQALETVQALLPVLCQAHGLTPQQVVAIASNIGGKQALETV QALLPVLCQAHGLTPQQVVAIASNGGGKQALETVQRLLPVLCQAHGLTPQQVVAIASNG GGKQALETVQRLLPVLCQAHGLTPQQVVAIASNGGGRPALESIVAQLSRPDPALAALTN DHLVALACLGGRPALDAVKKGLGDPISRSQLVKSELEEKKSELRHKLKYVPHEYIELIEIA |

TABLE 3-continued

Polypeptide sequences of TALEN-reagents used in the examples

| Nickname | SEQ ID # | Target gene | TALEN (Left and Right heterodimers) | TALEN Polypeptide Sequence |
|---|---|---|---|---|
| pCLS29715 | 66 | SHARPIN (Exon2) | Sharpin_ex2_1-R1 | RNSTQDRILEMKVMEFMKVYGYRGKHLGGSRKPDGAIYTVGSPIDYGVIVDTKAYSGG YNLPIGQADEMQRYVEENQTRNKHINPNEWKVYPSSVTEFKFLFVSGHFKGNYKAQL TRLNHITNCNGAVLSVEELLIGGEMIKAGTLTLEEVRRKFNNGEINFAAD |
| pCLS29716 | 67 | SHARPIN (Exon3) | Sharpin_ex3-L1 | MGDPKKKRKVIDYPYDVPDYAIDIADLRTLGYSQQQEKIKPKVRSTVAQHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNNGGKQA LETVQRLLPVLCQAHGLTPQQVVAIASNNGGKQALETVQRLLPVLCQAHGLTPQQVVAI ASNGGGKQALETVQRLLPVLCQAHGLTPQQVVAIASNNGGKQALETVQRLLPVLCQAH GLTPQQVVAIASNGGGKQALETVQRLLPVLCQAHGLTPEQVVAIASNIGGKQALETVQA LLPVLCQAHGLTPQQVVAIASNNGGKQALETVQRLLPVLCQAHGLTPQQVVAIASNNGG KQALETVQRLLPVLCQAHGLTPQQVVAIASNIGGKQALETVQALLPVLCQAHGLTPEQVV AIASNIGGKQALETVQRLLPVLCQAHGLTPEQVVAIASNIGGKQALETVQALLPVLCQAH GLTPEQVVAIASHDGGKQALETVQRLLPVLCQAHGLTPQQVVAIASNNGGKQALETVQ RLLPVLCQAHGLTPQQVVAIASNNGGKQALETVQRLLPVLCQAHGLTPEQVVAIASNIG GKQALETVQALLPVLCQAHGLTPQQVVAIASNGGGRPALESIVAQLSRPDPALAALTND HLVALACLGGRPALDAVKKGLGDPISRSQLVKSELEKKSELRHKLKYVPHEYIELIEIAR NSTQDRILEMKVMEFMKVYGYRGKHLGGSRKPDGAIYTVGSPIDYGVIVDTKAYSGGY NLPIGQADEMQRYVEENQTRNKHINPNEWKVYPSSVTEFKFLFVSGHFKGNYKAQLT RLNHITNCNGAVLSVEELLIGGEMIKAGTLTLEEVRRKFNNGEINFAAD |
| pCLS29717 | 68 | SHARPIN (Exon3) | Sharpin_ex3-R1 | MGDPKKKRKVIDYPYDVPDYAIDIADLRTLGYSQQQEKIKPKVRSTVAQHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNIGGKQAL ETVQALLPVLCQAHGLTPQQVVAIASNGGGKQALETVQRLLPVLCQAHGLTPEQVVAIA SHDGGKQALETVQRLLPVLCQAHGLTPQQVVAIASNGGKQALETVQRLLPVLCQAHG LTPQQVVAIASNGGGKQALETVQRLLPVLCQAHGLTPEQVVAIASNIGGKQALETVQALL PVLCQAHCLIPEQVVAIASNGGGKQALETVQRLLPVLCQAHGLTPQVVAIASHDGGKQ ALETVQRLLPVLCQAHGLTPQQVVAIASNGGGKQALETVQRLLPVLCQAHGLTPEQVVA IASHDGGKQALETVQRLLPVLCQAHGLTPQQVVAIASNNGGKQALETVQRLLPVLCQAH GLTPEQVVAIASNIGGKQALETVQALLPVLCQAHGLTPQQVVAIASNNGGKQALETVQR LLPVLCQAHGLTPQQVVAIASNNGGKQALETVQRLLPVLCQAHGLTPEQVVAIASHDGG KQALETVQRLLPVLCQAHGLTPQQVVAIASNGGGRPALESIVAQLSRPDPALAALTNDH LVALACLGGRPALDAVKKGLGDPISRSQLVKSELEKKSELRHKLKYVPHEYIELIEIARN STQDRILEMKVMEFMKVYGYRGKHLGGSRKPDGAIYTVGSPIDYGVIVDTKAYSGGYN LPIGQADEMQRYVEENQTRNKHINPNEWWKVYPSSVTEFKFLFVSGHFKGNYKAQLTR LNHITNCNGAVLSVEELLIGGEMIKAGTLTLEEVRRKFNNGEINFAAD |
| pCLS29717 | 68 | SHARPIN (Exon3) | Sharpin_ex3-R1 | MGDPKKKRKVIDYPYDVPDYAIDIADLRTLGYSQQQEKIKPKVRSTVAQHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNNGGKQA LETVQRLLPVLCQAHGLTPQQVVAIASNNGGKQALETVQRLLPVLCQAHGLTPQQVVAI ASNNGGKQALETVQRLLPVLCQAHGLTPEQVVAIASHDGGKQALETVQRLLPVLCQAH GLTPEQVVAIASHDGGKQALETVQRLLPVLCQAHGLTPQQVVAIASNNGGKQALETVQR LLPVLCQAHGLTPEQVVAIASNNGGKQALETVQRLLPVLCQAHGLTPQQVVAIASNIGGK QALETVQALLPVLCQAHGLTPEQVVAIASNNGGKQALETVQRLLPVLCQAHGLTPQQVV AIASNNGGKQALETVQRLLPVLCQAHGLTPEQVVAIASHDGGKQALETVQRLLPVLCQA |

TABLE 3-continued

Polypeptide sequences of TALEN-reagents used in the examples

| Nickname | SEQ ID # | Target gene | TALEN (Left and Right heterodimers) | TALEN Polypeptide Sequence |
|---|---|---|---|---|
| | | | | HGLTPQQVVAIASNGGGKQALETVQRLLPVLCQAHGLTPQQVVAIASNNG QRLLPVLCQAHGLTPQQVVAIASNNGGKCIALETVQRLLPVLCQAHGLTPQQVVAIASNG GGKQALETVQRLLPVLCQAHGLTPQQVAIASNGGRPALESIVAQLSRPDPALAALTN DHIVALACLGGRPALDAVKKGLGDPISRSQLVKSELEEKKSELRHKLKYVPHEYIELIEIA RNSTQDRILEMKVMEFFMKVYGYRGKHLGGSRKPDGAIYTVGSPIDYGVIVDTKAYSGG YNLPIGQADEMQRYVEENQTRNKHINPNEWWKVYPSSVTEFKFLFVSGHFKGNYKAQL TRLNHITNCNGAVLSVEELLIGGEMIKAGTLTLEEVRRKFNNGEINFAAD |
| pCLS30842 | 69 | MIR21 | miR21_1-L1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAEVHAWRNALTGAPLNLTPQQVVAIASNNGGKQA LETVQRLLPVLCQAHGLTPQQVVAIASNGGKQALETVQRLLPVLCQAHGLTPEQVVAI ASNIGGKQALETVQALLPVLCQAHGLTPEQVVAIASHDGGKQALETVQRLLPVLCQAHG LTPEQVVAIASHDGGKQALETVQRLLPVLCQAHGLTPEQVVAIASNIGGKQALETVQALL PVLCQAHGLTPEQVVAIASHDGGKQALETVQRLLPVLCQAHGLTPQQVVAIASHDGGKQ ALETVQRLLPVLCQAHGLTPQQVVAIASNGGGKQALETVQRLLPVLCQAHGLTPQQVVA IASNGGKQALETVQRLLPVLCQAHGLTPQQVVAIASNNGGKQALETVQRLLPVLCQAH GLTPQQVVAIASHDGGKQALETVQRLLPVLCQAHGLTPEQVVAIASNGGKQALETVQ RLLPVLCQAHGLTPQQVVAIASNGGKQALETVQRLLPVLCQAHGLTPQQVVAIASNNG GKQALETVQRLLPVLCQAHGLTPQQVVAIASNGGGRPALESIVAQLSRPDPALAALTND HLVALACLGGRPALDAVKKGLGDPISRSQLVKSELEEKKSELRHKLKYVPHEYIELIEIAR NSTQDRILEMKVMEFFMKVYGYRGKHLGGSRKPDGAIYTVGSPIDYGVIVDTKAYSGGY NLPIGQADEMQRYVEENQTRNKHINPNEWWKVYPSSVTEFKFLFVSGHFKGNYKAQLT RLNHITNCNGAVLSVEELLIGGEMIKAGTLTLEEVRRKFNNGEINFAAD |
| pCLS30843 | 70 | MIR21 | miR21_1-R1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAEVHAWRNALTGAPLNLTPQQVVAIASNGGGKQ ALETVQRLLPVLCQAHGLTPEQVVAIASHDGGKQALETVQRLLPVLCQAHGLTPEQVVAI ASNIGGKQALETVQALLPVLCQAHGLTPEQVVAIASNIGGKQALETVQALLPVLCQAHGL TPEQVVAIASHDGGKQALETVQRLLPVLCQAHGLTPEQVVAIASNIGGKQALETVQALLP VLCQAHGLTPQQVVAIASNNGGKQALETVQRLLPVLCQAHGLTPQQVVAIASNGGGKQ ALETVQRLLPVLCQAHGLTPEQVVAIASHDGGKQALETVQRLLPVLCQAHGLTPEQVVAI ASNIGGKQALETVQALLPVLCQAHGLTPEQVVAIASNIGGKQALETVQALLPVLCQAHGL TPEQVVAIASHDGGKQALETVQRLLPVLCQAHGLTPVLCQAHGLTPQQVVAIASHDGGKQALETVQALLP VLCQAHGLTPQQVVAIASNGGGKQALETVQRLLPVLCQAHGLTPEQVVAIASHDGGKQ ALETVQRLLPVLCQAHGLTPQQVVAIASNGGGRPALESIVAQLSRPDPALAALTNDHLVA LACLGGRPALDAVKKGLGDPISRSQLVKSELEEKKSELRHKLKYVPHEYIELIEIARNSTQ DRILEMKVMEFFMKVYGYRGKHLGGSRKPDGAIYTVGSPIDYGVIVDTKAYSGGYNLPI GQADEMQRYVEENQTRNKHINPNEWWKVYPSSVTEFKFLFVSGHFKGNYKAQLTRLN HITNCNGAVLSVEELLIGGEMIKAGTLTLEEVRRKFNNGEINFAAD |
| pCLS30844 | 71 | MIR21 | miR21_2-L1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAEVHAWRNALTGAPLNLTPQQVVAIASNIGGKQAL ETVQALLPVLCQAHGLTPEQVVAIASHDGGKQALETVQRLLPVLCQAHGLTPEQVVAIA SHDGGKQALETVQRLLPVLCQAHGLTPEQVVAIASNIGGKQALETVQALLPVLCQAHGL |

TABLE 3-continued

Polypeptide sequences of TALEN-reagents used in the examples

| Nickname | SEQ ID # | Target gene | TALEN (Left and Right heterodimers) | TALEN Polypeptide Sequence |
|---|---|---|---|---|
| | | | | TPEQVVAIASHDGGKQALETVQRLLPVLCQAHGLIPEQVVAIASHDGGKQALETVQRLL PVLCQAHGLTPQQVVAIASNGGKQALETVQRLLPVLCQAHGLTPQQVVAIASNNGGK QALETVQRLLPVLCQAHGLTPQQVVAIASNNGGKQALETVQRLLPVLCQAHGLTPQQV VAIASNGGKQALETVQRLLPVLCQAHGLTPEQVVAIASHDGGKQALETVQRLLPVLCQ AHGLTPQQVVAIASNNGGKQALETVQRLLPVLCQAHGLTPQQVVAIASNNGGKQALETV QRLLPVLCQAHGLTPQQVVAIASNNGGKQALETVQRLLPVLCQAHGLTPQQVVAIASNG GGKQALETVQRLLPVLCQAHGLTPQQVVAIASNGGRPALESIVAQLSRPDPALAALTN DHIVALACLGGRPALDAVKKGLGDPISRSQLVKSELEEKKSELRHKLKYVPHEYIELIEIA RNSTQDRILEMKVMEFFMKVYGYRGKHLGGSRKPDGAIYTVGSPIDYGVIVDTKAYSGG YNLPIGQADEMQRYVEENQTRNKHINPNEWWKVYPSSVTEFKFLFVSGHFKGNYKAQL TRLNHITNCNGAVLSVEELLIGGEMIKAGTLTLEEVRRKFNNGEINFAAD |
| pCLS30845 | 72 | MIR21 | miR21_2-R1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGVTAVEAVHAWRNALTGAPLNLTPQQVVAIASNNGGKQA LETVQRLLPVLCQAHGLTPEQVVAIASNIGGKQALETVQALLPVLCQAHGLTPQQVVAIA SNNGGKQALETVQRLLPVLCQAHGLTPEQVVAIASNIGGKQALETVQALLPVLCQAHGL TPQQVVAIASNGGKQALETVQRLLPVLCQAHGLTPQQVVAIASNGGKQALETVQRLL PVLCQAHGLTPEQVVAIASHDGGKQALETVQRLLPVLCQAHGLTPEQVVAIASNIGGKQ ALETVQALLPVLCQAHGLTPQQVVAIASNIGGKQALETVQALLPVLCQAHGLIPEQVVAI ASHDGGKQALETVQRLLPVLCQAHGLTPEQVVAIASNIGGKQALETVQALLPVLCQAHG LTPQQVVAIASNNGGKQALETVQRLLPVLCQAHGLTPQQVVAIASNGGKQALETVQRL LPVLCQAHGLTPEQVVAIASHDGGKQALETVQRLLPVLCQAHGLTPEQVVAIASNIGGK QALETVQALLPVLCQAHGLTPQQVVAIASNGGRPALESIVAQLSRPDPALAALTNDHLV ALACLGGRPALDAVKKGLGDPISRSQLVKSELEEKKSELRHKLKYVPHFYIELIEIARNST QDRILEMKVMEFFMKVYGYRGKHLGGSRKPDGAIYTVGSPIDYGVIVDTKAYSGGYNLP IGQADEMQRYVEENQTRNKHINPNEWWKVYPSSVTEFKFLFVSGHFKGNYKAQLITRLN HITNCNGAVLSVEELLIGGEMIKAGTLTLEEVRRKFNNGEINFAAD |
| pCLS30846 | 73 | MIR31 | miR31_1-L1 | MGDPKKKRKVIDYPYDVPDYAIDIADLRTLGYSQQQEKIKPKVRSTVAQHHEALVGHG FTHAHIVALSQHPAALGTVAVKYQDMIMLPEATHEAIVGVGKQWSGARALEALLTVAGE LRGPPLQLDTGQLLKIAKRGVTAVEAVHAWRNALTGAPLNLTPQQVVAIASNNGGKQA LETVQRLLPVLCQAHGLTPEQVVAIASNGGGKQALETVQRLLPVLCQAHGLTPQQVVAI ASNIGGKIDALETVQALLPVLCQAHGLTPEQVVAIASNIGGKQALETVQALLPVLCQAHGL TPEQVVAIASHDGGKQALETVQRLLPVLCQAHGLTPQQVVAIASNGGKQALETVQRLL PVLCQAHGLTPQQVVAIASNGGKQALETVQRLLPVLCQAHGLTPEQVVAIASNNGGK QALETVQRLLPVLCQAHGLTPQQVVAIASNIGGKQALETVQALLPVLCQAH AIASNIGGKQALETVQRLLPVLCQAHGLTPEQVVAIASNIGGKQALETVQALLPVLCQAH GLTPEQVVAIASHDGGKQALETVQRLLPVLCQAHGLTPQQVVAIASNGGKQALETVQ RLLPVLCQAHGLTPQQVVAIASNNGGKQALETVQRLLPVLCQAHGLTPQQVVAIASNNG GKQALETVQRLLPVLCQAHGLTPQQVVAIASNGGRPALESIVAQLSRPDPALAALTND HLVALACLGGRPALDAVKKGLGDPISRSQLVKSELEEKKSELRHKLKYVPHEYIELEIAR NSTQDRILEMKVMEFFMKVYGYRGKHLGGSRKPDGAIYTVGSPIDYGVIVDTKAYSGGY NLPIGQADEMQRYVEENQTRNKHINPNEWWKVYPSSVTEFKFLFVSGHFKGNYKAQLT RLNHITNCNGAVLSVEELLIGGEMIKAGTLTLEEVRRKFNNGEINFAAD |

TABLE 3-continued

Polypeptide sequences of TALEN-reagents used in the examples

| Nickname | SEQ ID # | Target gene | TALEN (Left and Right heterodimers) | TALEN Polypeptide Sequence |
|---|---|---|---|---|
| pCLS30847 | 74 | MIR31 | miR31_1-R1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNGGGKQ ALETVQRLLPVLCQAHGLTPEQVVAIASHDGGKQALETVQRLLPVLCQAHGLTPEQVVAI ASNIGGKQALETVQALLPVLCQAHGLTPEQVVAIASNIGGKQALETVQRLLPVLCQAHGL TPEQVVAIASHDGGKQALETVQRLLPVLCQAHGLTPEQVVAIASNIGGKQALETVQALLP VLCQAHGLTPQQVVAIASNNGGKQALETVQRLLPVLCQAHGLTPQQVVAIASHDGGKQ ALETVQRLLPVLCQAHGLTPQQVVAIASNNGGKQALETVQRLLPVLCQAHGLTPEQVVA IASNIGGKQALETVQALLPVLCQAHGLTPQQVVAIASNNGGKQALETVQRLLPVLCQAH GLTPQQVVAIASNNGGKQALETVQRLLPVLCQAHGLTPQQVVAIASHDGGKQALETVQR LLPVLCQAHGLTPEQVVAIASHDGGKQALETVQRLLPVLCQAHGLTPEQVVAIASNIGGK QALETVQALLPVLCQAHGLTPQQVVAIASNGGGRPALESIVAQLSRPDPALAALTNDHLV ALACLGRPALDAVKKGLGDPISRSQLVKSELEEKKSELRHKLKVPHEYIELIEIARNST QDRILEMKVMEFFMKVYGYRGKHLGGSRKPDGAIYTVGSPIDYGVIVDTKAYSGGYNLP IGQADEMQRYVEENQTRNKHINPNEWWKVYPSSVTEFKFLFVSGHFKGNYKAQLTRLN HITNCNGAVLSVEELLIGGEMIKAGTLTLEEVRRKFNNGEINFAAD |
| pCLS30848 | 75 | MIR31 | miR31_2-L1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNGGGKQ ALETVQRLLPVLCQAHGLTPQQVVAIASNNGGKQALETVQRLLPVLCQAHGLTPQQVVA IASNNGKQALETVQALLPVLCQAHGLTPEQVVAIASNIGGKQALETVQRLLPVLCQAHG LTPEQVVAIASNICGKQALETVQALLPVLCQAHGLTPEQVVAIASHDGGKQALETVQRLL PVLCQAHGLTPQQVVAIASNGGGKQALETVQRLLPVLCQAHGLTPEQVV AIASNIGGKQALETVQLLPVLCQAHGLTPQQVVAIASNNGGKQALETVQRLLPVLCQAH GLTPEQVVAIASNIGGKQALETVQALLPVLCQAHGLTPQQVVAIASNNCCKQALETVQR LLPVLCQAHGLTPQQVVAIASNNGGKQALETVQRLLPVLCQAHGLTPEQVVAIASNIGGK QALETVQALLPVLCQAHGLTPQQVVAIASNGGGRPALESIVAQLSRPDPALAALTNDHLV ALACLGRPALDAVKKGLGDPISRSQLVKSELEEKKSELRHKLKVPHEYIELIEIARNST QDRILEMKVMEFFMKVYGYRGKHLGGSRKPDGAIYTVGSPIDYGVIVDTKAYSGGYNLP IGQADEMQRYVEENQTRNKHINPNEWWKVYPSSVTEFKFLFVSGHFKGNYKAQLTRLN HITNCNGAVLSVEELLIGGEMIKAGTLTLEEVRRKFNNGEINFAAD |
| pCLS30849 | 76 | MIR31 | miR31_2-R1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASHDGGKQA LETVQRLLPVLCQAHGLTPEQVVAIASHDGGKQALETVQRLLPVLCQAHGLTPEQVVAIA SHDGGKQALETVQRLLPVLCQAHGLTPEQVVAIASNIGGKQALETVQALLPVLCQAHGL TPQQVVAIASNNGGKQALETVQRLLPVLCQAHGLTPQQVVAIASNNGGKQALETVQRLLI QALETVQRLLPVLCQAHGLTPEQVVAIASNNGGKQALETVQRLLPVLCQAHGLTPEQVVA IASNIGGKQALETVQALLPVLCQAHGLTPEQVVAIASHDGGKQALETVQRLLPVLCQAHG LTPEQVVAIASNIGGKQALETVQALLPVLCQAHGLTPQQVVAIASNNGGKQALETVQRLL PVLCGAHGLIPEQVVAIASNGGGRPALESIVAQLSRPDPALAALTNDHL QALETVQRLLPVLCQAHGLTPQQVVAIASHDGGKCIALETVQRLLPVLCQAHGLTPEQVVAIA VALACLGRPALDAVKKGLGDPISRSQLVKSELEEKKSELRHKLKVPHEYIELIEIARNS |

TABLE 3-continued

Polypeptide sequences of TALEN-reagents used in the examples

| Nickname | SEQ ID # | Target gene | TALEN (Left and Right heterodimers) | TALEN Polypeptide Sequence |
|---|---|---|---|---|
| | | | | TQDRILEMKVMEFFMKVYGYRGKHLGGSRKPDGAIYTVGSPIDYGVIVDTKAYSGGYNL PIGQADEMQRYVEENQTRNKHINPNEWKVYPSSVTEFKFLFVSGHFKGNYKAQLTRL NHITNCNGAVLSVEELLIGGEMIKAGTLTLEEVRRKFNNGEINFAAD |
| pCLS30850 | 77 | STAT1 | STAT1_1-L1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNGGGKQ ALETVQRLLPVLCQAHGLTPEQVVAIASHDGGKQALETVQRLLPVLCQAHGLTPEQVVAI ASHDGGKQALETVQRLLPVLCQAHGLTPEQVVAIASHDGGKQALETVQRLLPVLCQAH GLTPQQVVAIASNGGKQALETVQRLLPVLCQAHGLTPEQVVAIASNIGGKQALETVQA LLPVLCQAHGLTPQQVVAIASNGGGKQALETVQRLLPVLCQAHGLTPEQVVAIASNIGG KQALETVQALLPVLCQAHGLTPQQVVAIASNGGGKQALETVQALLPVLCQAHGLTPQQV VAIASNNGGKQALETVQRLLPVLCQAHGLTPEQVVAIASNIGGKQALETVQALLPVLCQA HGLTPQQVVAIASNGGKQALETVQRLLPVLCQAHGLTPQQVVAIASNNGGKQALETV QRLLPVLCQAHGLTPQQVVAIASNGGGKQALETVQRLLPVLCQAHGLTPEQVVAIASHD GGKQALETVQRLLPVLCQAHGLTPQQVVAIASNGGGRPALESIVAQLSRPDPALAALTN DHLVALACLGGRPALDAVKKGLGDPISRSQLVKSELEEKKSELRHKLKYVPHEYIELIEIA RNSTQDRILEMKVMEFFMKVYGYRGKHLGGSRKPDGAIYTVGSPIDYGVIVDTKAYSGG YNLPIGQADEMQRYVEENQTRNKHINPNEWKVYPSSVTEFKFLFVSGHFKGNYKAQL TRLNHITNCNGAVLSVEELLIGGEMIKAGTLTLEEVRRKFNNGEINFAAD |
| pCLS30851 | 78 | STAT1 | STAT1_1-R1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNGGGKQ ALETVQRLLPVLCQAHGLTPEQVVAIASNGGGKQALETVQRLLPVLCQAHG IASNNGGKQALETVQRLLPVLCQAHGLTPEQVVAIASNIGGKQALETVQRL LTPQQVVAIASNNGGKQALETVQRLLPVLCQAHGLTPQQVVAIASNIGGKQALETVQALLPVLCQAHGLTPQQVV QALETVQALLPVLCQAHGLTIDEQVVAIASHDGGKCIALETVQRLLPVLCQAHGLTPQQVV AIASNNGGKQALETVQRLLPVLCQAHGLTIDEQVVAIASHDGGKQALETVQRLLPVLCQA HGLTPQQVVAIASNGGGKQALETVQRLLPVLCQAHGLTPQQVVAIASNNGGKQALETV GGKQALETVQRLLPVLCQAHGLTPQQVVAIASNGGGRPALESIVAQLSRPDPALAALTN DHLVALACLGGRPALDAVKKGLGDPISRSQLVKSELEEKKSELRHKLKYVPHEYIELIEIA RNSTQDRILEMKVMEFFMKVYGYRGKHLGGSRKPDGAIYTVGSPIDYGVIVDTKAYSGG YNLPIGQADEMQRYVEENQTRNKHINPNEWKVYPSSVTEFKFLFVSGHFKGNYKAQL TRLNHITNCNGAVLSVEELLIGGEMIKAGTLTLEEVRRKFNNGEINFAAD |
| pCLS30852 | 79 | STAT1 | STAT1_2-L1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNGGKQA LETVQRLLPVLCQAHGLTPQQVVAIASNGGGKQALETVQRLLPVLCQAHGLTPEQVVAI ASHDGGKQALETVQRLLPVLCQAHGLTPQQVVAIASNGGGKQALETVQRLLPVLCQAH GLTPEQVVAIASHDGGKQALETVQRLLPVLCQAHGLTPEQVVAIASNIGGKQALETVQAL LPVLCQAHGLTPQQVVAIASNNGGKQALETVQRLLPVLCQAHGLTPQQ KQALETVQRLLPVLCQAHGLTPQQVVAIASNGGKQALETVQRLLPVLC VVAIASNNGGKQALETVQRLLPVLCQAHGLTPQQVVAIASNGGGKQALETVQRLLPVLC |

TABLE 3-continued

Polypeptide sequences of TALEN-reagents used in the examples

| SEQ ID # | Target gene | Nickname | TALEN (Left and Right heterodimers) | TALEN Polypeptide Sequence |
|---|---|---|---|---|
| | | pCLS30853 | | QAHGLTPEQVVAIASNIGGKQALETVQALLPVLCQAHGLTPEQVVAIASHDGGKQALET VQRLLPVLCQAHGLTPQQVVAIASNNGGKQALETVQRLLPVLCQAHGLTPEQVVAIASNI GGKQALETVQALLPVLCQAHGLTPQQVVAIASNGGGRPALESIVAQLSRPDPALAALTN DHLVALACLGGRPALDAVKKGLGDPISRSQLVKSELEEKKSELRHKLKYVPHEYIELIEIA RNSTQDRILEMKVMEFFMKVYGYRGKHLGGSRKPDGAIYTVGSPIDYGVIVDTKAYSGG YNLPIGQADEMQRYVEENQTRNKHINPNEWWKVYPSSVTEFKFLFVSGHFKGNYKAQL TRLNHITNCNGAVLSVEELLIGGEMIKAGTLTLEEVRRKFNNGEINFAAD |
| 80 | STAT1 | pCLS30853 | STAT1_2-R1 | MGDPKKKRKVIDYPYDVPDYAIDIADLRTLGYSQQQEKIKPKVRSTVAQHHEALVGHG FTHAHIVALSQHPAALGTVAVKYQDMIMLPEATHEAIVGKQKWSGARALEALLTVAGE LRGPPLQLDTGQLLKIAKRGGVTAVEAVHAWRNALTGAPLNLTPQQVVAIASNNGGKQA LETVQRLLPVLCQAHGLTPEQVVAIASHDGGKQALETVQRLLPVLCQAHGLTPQQVVAI ASNGGGKQALETVQRLLPVLCQAHGLTPEQVVAIASHDGGKQALETVQRLLPVLCQAH GLTPEQVVAIASNIGGKQALETVQRLLPVLCQAHGLTPEQVVAIASNIGGKQALETVQAL LPVLCQAHGLTPQQVVAIASNNGGKQALETVQRLLPVLCQAHGLTPQQVVAIASNNGGK QALETVQRLLPVLCQAHGLTPEQVVAIASNGGGKQALETVQALLPVLCQAHGLTPEQVVA IASNIGGKQALETVQALLPVLCQAHGLTPQQVVAIASNGGGKQALETVQRLLPVLCQAH GLTPQQVVAIASNGGGKQALETVQRLLPVLCQAHGLTPQQVVAIASNGGGKQALETVQ RLLPVLCQAHGLTPQQVALLPVLCQAHGLTPQQVVAIASNGGGKQALETVQRLLPVLCQAHGLTPQQVVAIASNNG GKQALETVQRLLPVLCQAHGLTPQQVVAIASNGGGKQALETVQRLLPVLCQAHGLTPQQVVAIASNGGGKQALESIVAQLSRPDPALAALTND HLVALACLGGRPALDAVKKGLGDPISRSQLVKSELEEKKSELRHKLKYVPHEYIELIEIAR NSTQDRILEMKVMEFFMKVYGYRGKHLGGSRKPDGAIYTVGSPIDYGVIVDTKAYSGGY NLPIGQADEMQRYVEENQTRNKHINPNEWWKVYPSSVTEFKFLFVSGHFKGNYKAQLT RLNHITNCNGAVLSVEELLIGGEMIKAGTLTLEEVRRKFNNGEINFAAD |
| 81 | MIR26 | pCLS30854 | 26A1_1-L1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNNGGKQA LETVQRLLPVLCQAHGLTPQQVVAIASNNGGKQALETVQRLLPVLCQAHGLTPEQVVAI ASHDGGKQALETVQRLLPVLCQAHGLTPQQVVAIASNNGGKQALETVQRLLPVLCQAH GLTPEQVVAIASNIGGKQALETVQALLPVLCQAHGLIPEQVVAIASNIGGKQALETVQALL PVLCQAHGLTPQQVVAIASNNGGKQALETVQRLLPVLCQAHGLTPQQVVAIASNNGGK QALETVQRLLPVLCQAHGLTPEQVVAIASHDGGKQALETVQRLLPVLCQAHGLTPEQVV AIASHDGGKQALETVQRLLPVLCQAHGLTPQQVVAIASNNGGKQALETVQRLLPVLCQA HGLTPQQVVAIASNNGGKQALETVQRLLPVLCQAHGLTPQQVVAIASNNGGKQALETV QRLLPVLCQAHGLTPQQVVAIASNNGGKQALETVQRLLPVLCQAHGLTPEQVVAIASHD GGKQALETVQRLLPVLCQAHGLTPQQVVAIASNGGGRPALESIVAQLSRPDPALAALTN DHLVALACLGGRPALDAVKKGLGDPISRSQLVKSELEEKKSELRHKLKYVPHEYIELIEIA RNSTQDRILEMKVMEFFMKVYGYRGKHLGGSRKPDGAIYTVGSPIDYGVIVDTKAYSGG YNLPIGQADEMQRYVEENQTRNKHINPNEWWKVYPSSVTEFKFLFVSGHFKGNYKAQL TRLNHITNCNGAVLSVEELLIGGEMIKAGTLTLEEVRRKFNNGEINFAAD |
| 82 | MIR26 | pCLS30855 | 26A1_1-R1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNNGGKQA LETVQRLLPVLCQAHGLTPEQVVAIASHDGGKQALETVQRLLPVLCQAHGLTPEQVVAIA SNIGGKQALLPVLCQAHGLTPQQVVAIASHDGGKQALETVQRLLPVLCQAHGL |

TABLE 3-continued

Polypeptide sequences of TALEN-reagents used in the examples

| Nickname | SEQ ID # | Target gene | TALEN (Left and Right heterodimers) | TALEN Polypeptide Sequence |
|---|---|---|---|---|
| pCLS30856 | 83 | MIR26 | 26A1_2-L1 | TPEQVVAIASNIGGKQALETVQALLPVLCQAHGLTPQQVVAIASNNGGKQALETVQRLLP VLCQAHGLTPEQVVAIASHDGGKQALETVQRLLPVLCQAHGLTPQQVVAIASHDGGKQA LETVQRLLPVLCQAHGLTPQQVVAIASNGGGKQALETVQRLLPVLCQAHGLTPEQVVAI ASNIGGKQALETVQALLPVLCQAHGLTPQQVVAIASNGGKQALETVQRLLPVLCQAHG LTPEQVVAIASHDGGKQALETVQRLLPVLCQAHGLTPEQVVAIASHDGGKQALETVQRL LPVLCQAHGLTPQQVVAIASNGGGKQALETVQRLLPVLCQAHGLTPQQVVAIASNNGG KQALETVQRLLPVLCQAHGLTPQQVVAIASNGGGRPALESIVAQLSRPDPALAALTNDH LVALACLGGRPALDAVKKGLGDPISRSQLVKSELEKKSELRHKLKYVPHEYIELIEIARN STQDRILEMKVMEFFMKVYGYRGKHLGGSRKPDGAIYTVGSPIDYGVIVDTKAYSGGYN LPIGQADEMQRYVEENQTRNKHINPNEWWKVYPSSVTEFKFLFVSGHFKGNYKAQLTR LNHITNCNGAVLSVEELLIGGEMIKAGTLTLEEVRRKFNNGEINFAAD |
| | | | | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLLKIIAKRGVTAVEAVHAWRNALTGAPLNLTPEQVVAIASHDGGKQA LETVQRLLPVLCQAHGLTPQQVVAIASHDGGKQALETVQRLLPVLCQAHGLTPEQVVAIA SNIGGKQALETVQALLPVLCQAHGLTPQQVVAIASNGGKQALETVQRLLPVLCQAHGL TPQQVVAIASHDGGKQALETVQRLLPVLCQAHGLTPEQVVAIASNGGKQALETVQALLP VLCQAHGLTPQQVVAIASNGGKCIALETVQRLLPVLCQAHGLTPEQVVAIASNIGGKQA LETVQALLPVLCQAHGLTPQQVVAIASNGGKQALETVQRLLPVLCQAHGLTPQQVVAI ASNNGGKQALETVQRLLPVLCQAHGLTPEQVVAIASHDGGKQALETVQRLLPVLCQAH GLTPQQVVAIASNGGGKQALETVQRLLPVLCQAHGLTPQQVVAIASNNGGKQALETVQ RLLPVLCQAHGLTPQQVVAIASNGGGKQALETVQRLLPVLCQAHGLTPQQVVAIASNNG GKQALETVQRLLPVLCQAHGLTPQQVVAIASNGGGRPALESIVAQLSRPDPALAALTND HIVALACLGGRPALDAVKKGLGDPISRSQLVKSELEKKSELRHKLKYVPHEYIELIEIAR NSTQDRILEMKVMEFFMKVYGYRGKHLGGSRKPDGAIYTVGSPIDYGVIVDTKAYSGGY NLPIGQADEMQRYVEENQTRNKHINPNEWWKVYPSSVTEFKFLFVSGHFKGNYKAQLT RLNHITNCNGAVLSVEELLIGGEMIKAGTLTLEEVRRKFNNGEINFAAD |
| pCLS30857 | 84 | MIR26 | 26A1_2-R1 | MGDPKKKRKVIDYPYDVPDYAIDIADLRTLGYSQQQEKIKPKVRSTVAQHHEALVGHG FTHAHIVALSQHPAALGTVAVKYQDMIMLPEATHEAIVGVGKQWSGARALEALLTVAGE LRGPPLQLDTGQLLLKIAKRGVTAVEAVHAWRNALTGAPLNLTPQQVVAIASNNGGKQA LETVQRLLPVLCQAHGLTPEQVVAIASHDGGKQALETVQRLLPVLCQAHGLTPEQVVAIA SNIGGKQALETVQALLPVLCQAHGLTPEQVVAIASNIGGKQALETVQALLPVLCQAHGLT PQQVVAIASNNGGKQALETVQRLLPVLCQAHGLTPQQVVAIASNGGKQALETVQRLLP VLCQAHGLTPEQVVAIASHDGGKQALETVQALLPVLCQAHGLTPEQVVAIASNIGGKQAL ETVQALLPVLCQAHGLTPEQVVAIASHDGGKQALETVQRLLPVLCQAHGLTPEQVVAIA SHDGGKQALETVQRLLPVLCQAHGLTPEQVVAIASNIGGKQALETVQRLLPVLCQAHGL TPEQVVAIASNIGGKQALETVQALLPVLCQAHGLTPQQVVAIASNNGGKQALETVQRLLP VLCQAHGLTPQQVVAIASNIGGKQALETVQALLPVLCQAHGLTPEQVVAIASNIGGKQAL ETVQALLPVLCQAHGLTPQQVVAIASNGGGRPALESIVAQLSRPDPALAALINDHIVALA CLGGRPALDAVKKGLGDPISRSQLVKSELEKKSELRHKLKYVPHEYIELIEIARNSTQDR ILEMKVMEFFMKVYGYRGKHLGGSRKPDGAIYTVGSPIDYGVIVDTKAYSGGYNLPIGQ ADEMQRYVEENQTRNKHINPNEWWKVYPSSVTEFKFLFVSGHFKGNYKAQLTRLNHIT NCNGAVLSVEELLIGGEMIKAGTLTLEEVRRKFNNGEINFAAD |

TABLE 3-continued

Polypeptide sequences of TALEN-reagents used in the examples

| Nickname | SEQ ID # | Target gene | TALEN (Left and Right heterodimers) | TALEN Polypeptide Sequence |
|---|---|---|---|---|
| pCLS30858 | 85 | MIR101 | miR101_1-L1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASHDGGKQA LETVQRLLPVLCQAHGLTPEQVVAIASHDGGKCALETVQRLLPVLCQAHGLTPQQVVAI ASNGGGKQALETVQRLLPVLCQAHGLTPQQVVAIASNGGGKQALETVQRLLPVLCQAH GLTPEQVVAIASHDGGKQALETVQRLLPVLCQAHGLTPEQVVAIASNIGGKQALETVQAL LPVLCQAHGLTPQQVVAIASNGGGKQALETVQRLLPVLCQAHGLTPQQVVAIASNGGG KQALETVQRLLPVLCQAHGLTPQQVVAIASNGGGKQALETVQRLLPVLCQAHGLTPEQV VAIASNIGGKQALETVQLLPVLCQAHGLTPQQVVAIASNGGGKQALETVQRLLPVLCQA HGLTPEQVVAIASHDGGKQALETVQRLLPVLCQAHGLTPQQVVAIASNIGGKQALETVQ ALLPVLCQAHGLTPEQVVAIASHDGKQALETVQRLLPVLCQAHGLTPEQVVAIASNIGG KQALETVQALLPVLCQAHGLTPQQVVAIASNGGGRPALESIVAQLSRPDPALAALTNDHL VALACLGGRPALDAVKKGLGDPISRSQLVKSELEKKSELRHKLKVPHEYIELIEIARNS TQDRILEMKVMEFFMKVYGYRGKHLGGSRKPDGAIYTVGSPIDYGVIVDTKAYSGGVNL PIGQADEMQRYVEENQTRNKHINPNEWWKVYPSSVTEFKFLFVSGHFKGNYKAQLTRL NHITNCNGAVLSVEELLIGGEMIKAGTLTLEEVRRKFNNGEINFAAD |
| pCLS30859 | 86 | MIR101 | miR101_1-R1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNGGKQA LETVQRLLPVLCQAHGLTPEQVVAIASHDGGKQALETVQRLLPVLCQAH ASNGGGKQALETVQRLLPVLCQAHGLTPQQVVAIASNGGGKQALETVQRLLPVLCQAH GLTPEQVVAIASNIGGKQALETVQALLPVLCQAHGLTPQQVVAIASNGGGKQALETVQR LLPVLCQAHGLTPQQVVAIASNGGGKQALETVQRLLPVLCQAHGLTPEQVVAIASHDGG KQALETVQRLLPVLCQAHGLTPQQVVAIASNGGGKQALETVQRLLPVLC VVAIASNGGGKQALETVQRLLPVLCQAHGLTPQQVVAIASNGGGKQALE QAHGLIPEQVVAIASHDGGKQALETVQRLLPVLCQAHGLTPQQVVAIASN TVQRLLPVLCQAHGLTPQQVVAIASNIGGKQALETVQALLPVLCQAHGLTPQQVVAIASN GGGKQALETVQRLLPVLCQAHGLTPQQVVAIASNGGGRPALESIVAQLSRPDPALAALT NDHLVALACLGGRPALDAVKKGLGDPISRSQLVKSELEEKKSELRHKLKVPHEYIELIEI ARNSTQDRILEMKVMEFFMKVYGYRGKHLGGSRKPDGAIYTVGSPIDYGVIVDTKAYSG GYNLPIGQADEMQRYVEENQTRNKHINPNEWWKVYPSSVTEFKFLFVSGHFKGNYKAQ LTRLNHITNCNGAVLSVEELLIGGEMIKAGTLTLEEVRRKFNNGEINFAAD |
| pCLS30860 | 87 | MIR101 | miR101_2-L1 | MGDPKKKRKVIDYPYDVPDYAIDIADLRTLGYSQCQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNGGKQA LETVQRLLPVLCQAHGLTPQQVVAIASNGGGKQALETVQRLLPVLCQAHGLTPEQVVAI ASHDGGKQALETVQRLLPVLCQAHGLTPQQVVAIASNGGGKQALETVQRLLPVLCQAH GLTPQQVVAIASNGGGKQALETVQRLLPVLCQAHGLTPEQVVAIASHDGGKQALETVQR LLPVLCQAHGLTPQQVVAIASNGGGKQALETVQRLLPVLCQAHGLTPEQVV QALETVQALLPVLCQAHGLTPQQVVAIASNGGGKQALETVQRLLPVLCQAHGLTPEQVV AIASHDGGKQALETVQRLLPVLCQAHGLTPQQVVAIASNGGGKQALETVQRLLPVLCQA HGLTPQQVVAIASNGGGKQALETVQRLLPVLCQAHGLTPQQVVAIASNIG QRLLPVLCQAHGLTPQQVVAIASHDGGKQALETVQRLLPVLCQAHGLTPEQVVAI GKQALETVQALLPVLCQAHGLTPQQVVAIASNGGGRPALESIVAQLSRPDPALAALTND HLVALACLGGRPALDAVKKGLGDPISRQLVKSELEKKSELRHKLKVPHEYIELIEIAR |

TABLE 3-continued

Polypeptide sequences of TALEN-reagents used in the examples

| Nickname | SEQ ID # | Target gene | TALEN (Left and Right heterodimers) | TALEN Polypeptide Sequence |
|---|---|---|---|---|
| pCLS30861 | 88 | MI R101 | miR101_2-R1 | NSTQDRILEMKVMEFMKVYGRGKHLGGSRKPDGAIYTVGSPIDYGVIVDTKAYSGGY NLPIGQADEMQRYVEENQTRNKHINPNEWWKVYPSSVTEFKLFVSGHFKGNYKAQLT RLNHITNCNGAVLSVEELLIGGEMIKAGTLTLEEVRRKFNNGEINFAAD |
| pCLS30862 | 89 | MT2A (EXON1) | mt2a_exon1-L1 | MGDPKKKRKVIDYPYDVPDYAIDIADLRTLGYSQQQQEKIKPKVRSTVAQHHEALVGHG FTHAHIVALSQHPAALGTVAVKYQDMIAALPEATHEAIVGVGKQWSGARALEALLTVAGE LRGPPIQLDTGQLLLKIAKRGGVTAVEAVHAWRNALTGAPLNLTPQQVVAIASNNGGKQA LETVQRLLPVLCQAHGLTPEQVVAIASNGGGKQALETVQRLLPVLCQAHGLTPEQVVAI ASHDGGKQALETVQRLLPVLCQAHGLTPQQVVAIASNGGGKQALETVQRLLPVLCQAH GLTPEQVVAIASNIGGKQALETVQALLPVLCQAHGLTPQQVVAIASNGGGKQALETVQR LLPVLCQAHGLTPQQVVAIASNGGGKQALETVQRLLPVLCQAHGLTPQQVVAIASHDGG KQALETVQRLLPVLCQAHGLTPQQVVAIASNGGGKQALETVQRLLPVLCQAHGLTPEQV VAIASNIGGKQALETVQALLPVLCQAHGLTPEQVVAIASNIGGKQALETVQALLPVLCQA HGLTPEQVVAIASNIGGKQALETVQALLPVLCQAHGLTPQQVVAIASNGGKQALETVQ RLLPVLCQAHGLTPQQVVAIASNNGGKQALETVQRLLPVLCQAHGLTPQQVVAIASNGG GKQALETVQRLLPVLCQAHGLTPQQVVAINGGGRPALESIVAQLSRPDPALAALTND HLVALACLGGRPALDAVKKGLGDPISRSQLVKSELEEKKSELRHKLKYVPHEYIELIEIAR NSTQDRILEMKVMEFMKVYGRGKHLGGSRKPDGAIYTVGSPIDYGVIVDTKAYSGGY NLPIGQADEMQRYVEENQTRNKHINPNEWWKVYPSSVTEFKLFVSGHFKGNYKAQLT RLNHITNCNGAVLSVEELLIGGEMIKAGTLTLEEVRRKFNNGEINFAAD |
| pCLS30863 | 90 | MT2A (EXON1) | mt2a_exon1-R1 | MGDPKKKRKVIDYPYDVPDYAIDIADLRTLGYSQQQQEKIKPKVRSTVAQHHEALVGHG FTHAHIVALSQHPAALGTVAVKYQDMIAALPEATHEAIVGVGKQWSGARALEALLTVAGE LRGPPIQLDTGQLLLKIAKRGGVTAVEAVHAWRNALTGAPLNLTPEQVVAIASNIGGKQAL ETVQALLPVLCQAHGLTPEQVVAIASHDGGKQALETVQRLLPVLCQAHGLTPEQVVAIA SNIGGKCIALETVQALLPVLCQAHGLTPEQVVAIASHDGGKQALETVQRLLPVLCQAHGL TPQQVVAIASNGGGKQALETVQRLLPVLCQAHGLTPQQVVAIASNNGGKQALETVQRLL PVLCQAHGLTPQQVVAIASNNGGKQALETVQRLLPVLCQAHGLTPEQVV AIASNIGGKQALETVQRLLPVLCQAHGLTPQQVVAIASNGGGKQALETVQRLLPVLCQA |

TABLE 3-continued

Polypeptide sequences of TALEN-reagents used in the examples

| Nickname | SEQ ID # | Target gene | TALEN (Left and Right heterodimers) | TALEN Polypeptide Sequence |
|---|---|---|---|---|
| | | | | HGLTPEQVVAIASHDGKQALETVQRLLPVLCQAHGLTPEQVVAIASHDGKQALETVQ RLLPVLCQAHGLTPEQVVAIASHDGKQALETVQRLLPVLCQAHGLTPEQVVAIASHDG GKQALETVQRLLPVLCQAHGLTPQQVVAIASNGGGRPALESIVAQLSRPDPALAALTND HIVALACLGGRPALDAVKKGLGDPISRSQLVKSELEEKKSELRHKLKYVPHEYIELIEIAR NSTQDRILEMKVMEFFMKVYGYRGKHLGGSRKPDGAIYTVGSPIDYGVIVDTKAYSGGY NLPIGQADEMQRYVEENQTRNKHINPNEWWKVYPSSVTEFKFLFVSGHFKGNYKAQLT RLNHITNCNGAVLSVEELLIGGEMIKAGTLTLEEVRRKFNNGEINFAAD |
| pCLS30864 | 91 | MT2A (EXON2) | mt2a_exon2-L1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPEQVVAIASHDGGKQA LETVQRLLPVLCQAHGLTPEQVVAIASHDGKQALETVQRLLPVLCQAHGLTPQQVVAI ASNGGGKQALETVQRLLPVLCQAHGLTPQQVVAIASNGGKQALETVQRLLPVLCQAH GLTPQQVVAIASNGGKQALETVQRLLPVLCQAHGLTPQQVVAIASNGGKQALETVQR LLPVLCQAHGLTPEQVVAIASNIGGKQALETVQALLPVLCQAHGLTPQQVVAIASNNGGK QALETVQRLLPVLCQAHGLTPQQVVAIASNGGKQALETVQRLLPVLCQAHGLTPQQV VAIASNGGGKQALETVQRLLPVLCQAHGLTPQQVVAISNGGKQALETVQRLLPVLCQ AHGLTPEQVVAIASNGGGKQALETVQRLLPVLCQAHGLTPEQVVAIASHDGKQALETV QRLLPVLCQAHGLTPQQVVAIASNGGGKQALETVQRLLPVLCQAHGLTPEQVVAIASHD GGKQALETVQRLLPVLCQAHGLTPQQVVAIASNGGRPALESIVAQLSRPDPALAALTN DHLVALACLGGRPALDAVKKGLGDPISRSQLVKSELEEKKSELRHKLKYVPHFYIELIEIA RNSTQDRILEMKVMEFFMKVYGYRGKHLGGSRKPDGAIYTVGSPIDYGVIVDTKAYSGG YNLPIGQADEMQRYVEENQTRNKHINPNEWWKVYPSSVTEFKFLFVSGHFKGNYKAQL TRLNHITNCNGAVLSVEELLIGGEMIKAGTLTLEEVRRKFNNGEINFAAD |
| pCLS30865 | 92 | MT2A (EXON2) | mt2a_exon2-R1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPEQVVAIASHDGGKQA LETVQRLLPVLCQAHGLTPEQVVAIASNGGGKQALETVQRLLPVLCQAHGLTPQQVVAI ASNGGGKQALETVQRLLPVLCQAHGLTPQQVVAIASNGGKQALETVQRLLPVLCQAH GLTPQQVVAIASNGGKQALETVQRLLPVLCQAHGLTPEQVVAIASNGGGKQALETVQR LLPVLCQAHGLTPEQVVAIASNIGGKQALETVQALLPVLCQAHGLTPQQVVAIASNGGGK QALETVQRLLPVLCQAHGLTPQQVVAIASNGGKQALETVQRLLPVLCQAHGLTPQQV VAIASNGGKQALETVQRLLPVLCQAHGLTPQQVVAIASNIGGKQALETVQRLLPVLCQ AHGLTPEQVVAIASNGGKQALETVQRLLPVLCQAHGLTPEQVVAIASNIGGKQALETV QALLPVLCQAHGLTPQQVVAIASNGGKQALETVQRLLPVLCQAHGLTPEQVVAIASNN GGKQALETVQRLLPVLCQAHGLTPQQVVAIASNGGRPALESIVAQLSRPDPALAALTN DHLVALACLGGRPALDAVKKGLGDPISRSQLVKSELEEKKSELRHKLKYVPHFYIELIEIA RNSTQDRILEMKVMEFFMKVYGYRGKHLGGSRKPDGAIYTVGSPIDYGVIVDTKAYSGG YNLPIGQADEMQRYVEENQTRNKHINPNEWWKVYPSSVTEFKFLFVSGHFKGNYKAQL TRLNHITNCNGAVLSVEELLIGGEMIKAGTLTLEEVRRKFNNGEINFAAD |
| pCLS30866 | 93 | JAK2 | hsJAK2_1-L1 | MGDPKKKRKVIDYPYDVPDYAIDIADLRTLGYSQQQEKIKPKVRSTVAQHHEALVGHG FTHAHIVALSQHPAALGTVAVKYQDMILPEATHEAIVGVGKQWSGARALEALLTVAGE LRGPPLQLDTGQLLKIAKRGGVTAVEAVHAWRNALTGAPLNLTPEQVVAIASHDGGKQA LETVQRLLPVLCQAHGLTPEQVVAIASHDGGKCALETVQRLLPVLCQAHGLTPEQVVAIA SNIGGKQALETVQALLPVLCQAHGLTPQQVVAIASNNGGKQALETVQRLLPVLCQAHGL |

TABLE 3-continued

Polypeptide sequences of TALEN-reagents used in the examples

| Nickname | SEQ ID # | Target gene | TALEN (Left and Right heterodimers) | TALEN Polypeptide Sequence |
|---|---|---|---|---|
| | | | | TPQQVVAIASNGGGKQALETVQRLLPVLCQAHGLTPQQVVAIASNGGGKQALETVQRLL PVLCQAHGLTPEQVVAIASHDGGKQALETVQRLLPVLCQAHGLTPQQVVAIASNGGGK QALETVQRLLPVLCQAHGLTPQQVVAIASNGGGKQALETVQRLLPVLCQAHGLTPEQVV AIASHDGGKQALETVQRLLPVLCQAHGLTPEQVVAIASNIGGKQALETVQALLPVLCQAH GLTPQQVVAIASNGGKQALETVQRLLPVLCQAHGLTPQQVVAIASNGGGKQALETVQ RLLPVLCQAHGLTPQQVVAIASNGGGKQALETVQRLLPVLCQAHGLTPQQVVAIASNNG GKQALETVQRLLPVLCQAHGLTPQQVVAIASNGGGRPALESIVAQLSRPDPALAALTND HIVALACLGGRPALDAVKKGLGDPISRSQLVKSELEEKKSELRHKLKYVPHEYIELIEIAR NSTQDRILEMKVMEFFMKVYGYRGKHLGGSRKPDGAIYTVGSPIDYGVIVDTKAYSGGY NLPIGQADEMQRYVEENQTRNKHINPNEWKVYPSSVTEFKFLFVSGHFKGNYKAQLT RLNHITNCNGAVLSVEELLIGGEMIKAGTLTLEEVRRKFNNGEINFAAD |
| pCLS30867 | 94 | JAK2 | hsJAK2_1-R1 | MGDPKKKRKVIDYPYDVPDYAIDIADLRTLGYSQQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNNGGKQA LETVQRLLPVLCQAHGLTPEQVVAIASNIGGKQALETVQALLPVLCQAHGLTPQQVVAIA SHDGGKCIALETVQRLLPVLCQAHGLTPQQVVAIASNGGKQALETVQRLLPVLCQAHG LTPEQVVAIASHDGGKQALETVQRLLPVLCQAHGLTPEQVVAIASNIGGKQALETVQALL PVLCQAHGLTPQQVVAIASNGGKQALETVQRLLPVLCQAHGLTPEQVVAIASNIGGKQ ALETVQALLPVLCQAHGLTPQQVVAIASNGGGKQALETVQRLLPVLCQAHGLTPQQVVA IASNGGGKQALETVQRLLPVLCQAHGLTPEQVVAIASHDGGKQALETVQRLLPVLCQAH GLTPEQVVAIASHDGGKQALETVQRLLPVLCQAHGLTPEQVVAIASHDGGKQALETVQR LLPVLCQAHGLTPEQVVAIASHDGGKQALETVQRLLPVLCQAHGLTPEQVVAIASNIGGK QALETVQALLPVLCQAHGLTPQQVVAIASNGGGRPALESIVAQLSRPDPALAALTNDHLV ALACLGGRPALDAVKKGLGDPISRSQLVKSELEEKKSELRHKLKYVPHEYIELIEIARNST QDRILEMKVMEFFMKVYGRGKHLGGSRKPDGAIYTVGSPIDYGVIVDTKAYSGGYNLP IGQADEMQRYVEENQTRNKHINPNEWWKVYPSSVTEFKFLFVSGHFKGNYKAQLTRLN HITNCNGAVLSVEELLIGGEMIKAGTLTLEEVRRKFNNGEINFAAD |
| pCLS30868 | 95 | JAK2 | hsJAK2_2_L1 | MGDPKKKRKVIDYPYDVPDYAIDIADLRTLGYSQQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNNGGKQA LETVQRLLPVLCQAHGLTPEQVVAIASNIGGKQALETVQALLPVLCQAHGLTPQQVVAIA SNNGGKQALETVQRLLPVLCQAHGLTPQQVVAIASNGGGKQALETVQRLLPVLCQAHG LTPEQVVAIASHDGGKQALETVQRLLPVLCQAHGLTPEQVVAIASNIGGKQALETVQALL PVLCQAHGLTPQQVVAIASNGGKQALETVQRLLPVLCQAHGLTPQQVVAIASNIGGKQ ALETVQALLPVLCQAHGLTPEQVVAIASNGGGKQALETVQRLLPVLCQAHGLTPQQVVA IASNGGGKQALETVQRLLPVLCQAHGLTPEQVVAIASNIGGKQALETVQALLPVLCQAH GLTPQQVVAIASNGGGKQALETVQRLLPVLCQAHGLTPQQVVAIASNNGGKQALETVQ RLLPVLCQAHGLTPQQVVAIASNGGGKQALETVQRLLPVLCQAHGLTPQQVVAIASNNG GKQALETVQRLLPVLCQAHGLTPQQVVAIASNGGGRPALESLEEKKSELRHKLKYVPHEYIELIEIAR HIVALACLGGRPALDAVKKGLGDPISRSQLVKSELEEKKSELRHKLKYVPHEYIELIEIAR NSTQDRILEMKVMEFFMKVYGYRGKHLGGSRKPDGAIYTVGSPIDYGVIVDTKAYSGGY NLPIGQADEMQRYVEENQTRNKHINPNEWKVYPSSVTEFKFLFVSGHFKGNYKAQLT RLNHITNCNGAVLSVEELLIGGEMIKAGTLTLEEVRRKFNNGEINFAAD |

TABLE 3-continued

Polypeptide sequences of TALEN-reagents used in the examples

| Nickname | SEQ ID # | Target gene | TALEN (Left and Right heterodimers) | TALEN Polypeptide Sequence |
|---|---|---|---|---|
| pCLS30869 | 96 | JAK2 | hsJAK2_2-R1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGVTAVEAVHAWRNALTGAPLNLTPQQVVAIASNGGGKQ ALETVQRLLPVLCQAHGLTPEQVVAIASHDGGKQALETVQRLLPVLCQAHGLTPQQVVA IASNGGGKQALETVQRLLPVLCQAHGLTPQQVVAIASNGGKQALETVQRLLPVLCQAH GLTPEQVVAIASHDGGKQALETVQRLLPVLCQAHGLTPQQVVAIASNGGGKQALETVQ RLLPVLCQAHGLTPQQVVAIASNNGGKQALETVQRLLPVLCQAHGLTPEQVVAIASHDG GKQALETVQRLLPVLCQAHGLTPEQVVAIASNIGGKQALETVQALLPVLCQAHGLTPEQ VVAIASNIGGKQALETVQALLPVLCQAHGLTPEQVVAIASHDGGKQALETVQRLLPVLCQ AHGLTPEQVVAIASNIGGKQALETVQALLPVLCQAHGLTPQQVVAIASNGGGKQALETV QRLLPVLCQAHGLTPQQVVAIASNIGGKQALETVQALLPVLCQAHGLIPEQVVAIASHDG GKQALETVQRLLPVLCQAHGLTPQQVVAIASNGGGRPALESIVAQLSRPDPALAALTND HLVALACLGGRPALDAVKKGLGDPISRSQLVKSELEKKSELRHKLKYVPHEYIELIEIAR NSTQDRILEMKVMEFPMKVYGYRGKHLGGSRKPDGAIYTVGSPIDYGVIVDTKAYSGGY NLPIGQADEMQRYVEENQTRNKHINPNEWWKVYPSSVTEFKFLFVSGHFKGNYKAQLT RLNHITNCNGAVLSVEELLIGGEMIKAGTLTLEEVRRKFNNGEINFAAD |
| pCLS30870 | 97 | AURKA | hsAURKA_1-L1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGVTAVEAVHAWRNALTGAPLNLTPQQVVAIASNNGGKQA LETVQRLLPVLCQAHGLTPEQVVAIASNNGGKQALETVQRLLPVLCQAHGLTPEQVVAIA SHDGGKQALETVQRLLPVLCQAHGLTPQQVVAIASNGGGKQALETVQRLLPVLCQAHG LTPEQVVAIASHDGGKQALETVQRLLPVLCQAHGLTPEQVVAIASNIGGKQALETVQALL PVLCQAHGLTPQQVVAIASNNGGKQALETVQRLLPVLCQAHGLTPEQVVAIASHDGGK QALETVQRLLPVLCQAHGLTPEQVVAIASNIGGKQALETVQALLPVLCQAHGLTPEQVVA IASNIGGKQALETVQALLPVLCQAHGLTPQQVVAIASNGGGKQALETVQ GLTPQQVVAIASNGGGKQALETVQRLLPVLCQAHGLTPQQVVAIASNGGGKQALETVQ RLLPVLCQAHGLTPQQVVAIASHDGGKQALETVQRLLPVLCQAHGLTPEQVVAIASHDG GKQALETVQRLLPVLCQAHGLTPQQVVAIASNGGGRPALESIVAQLSRPDPALAALTND HLVALACLGGRPALDAVKKGLGDPISRSQLVKSELEKKSELRHKLKYVPHEYIELIEIAR NSTQDRILEMKVMEFPMKVYGYRGKHLGGSRKPDGAIYTVGSPIDYGVIVDTKAYSGGY NLPIGQADEMQRYVEENQTRNKHINPNEWWKVYPSSVTEFKFLFVSGHFKGNYKAQLT RLNHITNCNGAVLSVEELLIGGEMIKAGTLTLEEVRRKFNNGEINFAAD |
| pCLS30871 | 98 | AURKA | hsAURKA_1-R1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGVTAVEAVHAWRNALTGAPLNLTPQQVVAIASNNGGKQA LETVQRLLPVLCQAHGLTPQQVVAIASNNGGKQALETVQRLLPVLCQAHGLTPEQVVAI ASHDGGKQALETVQRLLPVLCQAHGLTPEQVVAIASHDGGKQALETVQRLLPVLCQAH GLTPEQVVAIASNIGGKQALETVQALLPVLCQAHGLTPEQVVAIASHDGGKQALETVQRL LPVLCQAHGLTPQQVVAIASNGGKQALETVQRLLPVLCQAHGLTPEQVVAIASNIGGK QALETVQALLPVLCQAHGLTPQQVVAIASNGGGKQALETVQRLLPVLCQAHGLTPQQV VAIASNGGGKQALETVQRLLPVLCQAHGLTPQQVVAIASHDGGKQALETVQRLLPVLCQ AHGLTPEQVVAIASNIGGKQALETVQALLPVLCQAHGLTPQQVVAIASHDGGKQALETV QRLLPVLCQAHGLTPQQVVAIASNIGGKQALETVQALLPVLCQAHGLTPEQVVAI ASNNG GKQALETVQRLLPVLCQAHGLTPQQVVAIASNGGGRPALESIVAQLSRPDPALAALTND HLVALACLGGRPALDAVKKGLGDPISRSQLVKSELEKKSELRHKLKYVPHEYIELIEIAR |

TABLE 3-continued

Polypeptide sequences of TALEN-reagents used in the examples

| Nickname | SEQ ID # | Target gene | TALEN (Left and Right heterodimers) | TALEN Polypeptide Sequence |
|---|---|---|---|---|
| | | | | NSTQDRILEMKVMEFFMKVYGYRGKHLGGSRKPDGAIYTVGSPIDYGVIVDTKAYSGGY NLPIGQADEMQRYVEENQTRNKHINPNEWWKVYPSSVTEFKFLFVSGHFKGNYKAQLT RLNHITNCNGAVLSVEELLIGGEMIKAGTLTLEEVRRKFNNGEINFAAD |
| pCLS30872 | 99 | AURKA | hsAURKA_2-L1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNNGGKQ ALETVQRLLPVLCQAHGLTPEQVVAIASNNGGKQALETVQRLLPVLCQAHGLTPQQVVA IASNNGGKQALETVQRLLPVLCQAHGLTPEQVVAIASHDGGKQALETVQRLLPVLCQAH GLTPQQVVAIASNNGGKQALETVQRLLPVLCQAHGLTPEQVVAIASHDGGKQALETVQ RLLPVLCQAHGLTPEQVVAIASHDGGKQALETVQRLLPVLCQAHGLTPEQVVAIASNIGG KQALETVQALLPVLCQAHGLTPQQVVAIASNNGGKQALETVQRLLPVLCQAHGLTPQQV VAIASNNGGKQALETVQRLLPVLCQAHGLTPEQVVAIASHDGGKQALETVQRLLPVLCQ AHGLTPEQVVAIASNIGGKQALETVQALLPVLCQAHGLIPEQVVAIASHDGGKQALETV QRLLPVLCQAHGLTPQQVVAIASNIGGKQALETVQALLPVLCQAHGLTPEQVVAIASNIG GKQALETVQALLPVLCQAHGLTPQQVVAIASNNGGRPALESIVAQLSRPDPALAALTND HLVALACLGGRPALDAVKKGLGDPISRSQLVKSELEEKKSELRHKLKYVPHEYIELEIAR NSTQDRILEMKVMEFFMKVYGYRGKHLGGSRKPDGAIYTVGSPIDYGVIVDTKAYSGGY NLPIGQADEMQRYVEENQTRNKHINPNEWWKVYPSSVTEFKFLFVSGHFKGNYKAQLT RLNHITNCNGAVLSVEELLIGGEMIKAGTLTLEEVRRKFNNGEINFAAD |
| pCLS30873 | 100 | AURKA | hsAURKA_2-R1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNNGGKQA LETVQRLLPVLCQAHGLTPEQVVAIASHDGGKQALETVQRLLPVLCQAHGLTPEQVVAIA SNIGGKQALETVQALLPVLCQAHGLTPEQVVAIASNIGGKQALLPVLCQAHGLTPEQVVAIASNT PQQVVAIASNNGGKQALETVQRLLPVLCQAHGLTPQQVVAIASNNGGKQALETVQRLL PVLCQAHGLTPQQVVAIASNNGGKQALETVQRLLPVLCQAHGLTPQVVAIASHDGGK QALETVQRLLPVLCQAHGLTPEQVVAIASNNGGKQALETVQRLLPVLCQAHGLTPQQV VAIASNNGGKQALETVQRLLPVLCQAHGLTPEQVVAIASHDGGKQALETVQRLLPVLCQ AHGLTPEQVVAIASNNGGKQALETVQRLLPVLCQAHGLTPQQVVAIASNNGGKQALET VQRLLPVLCQAHGLTPEQVVAIASHDGGKQALETVQRLLPVLCQAHGLTPQQVVAIASN GGGKQALETVQRLLPVLCQAHGLTPEQVVAIASNNGGRPALESIVAQLSRPDPALAALT NDHLVALACLGGRPALDAVKKGLGDPISRSQLVKSELEEKKSELRHKLKVPHEYIELIEI ARNSTQDRILEMKVMEFFMKVYGYRGKHLGGSRKPDGAIYTVGSPIDYGVIVDTKAYSG GYNLPIGQADEMQRYVEENQTRNKHINPNEWWKVYPSSVTEFKFLFVSGHFKGNYKAQ LTRLNHITNCNGAVLSVEELLIGGEMIKAGILTLEEVRRKFNNGEINFAAD |
| pCLS30874 | 101 | PTGER2 (Exon1) | ptger2_ex1-L1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNNGGKQ ALETVQRLLPVLCQAHGLTPEQVVAIASNNGGKQALETVQRLLPVLCQAHGLTPQQVVA IASNNGGKQALETVQRLLPVLCQAHGLTPEQVVAIASHDGGKQALETVQRLLPVLCQAH GLTPEQVVAIASHDGGKQALETVQRLLPVLCQAHGLIPEQVVAIASHDGGKQALETVQR LLPVLCQAHGLTPEQVVAIASNNGGKQALPVLCQAHGLTPEQVVAIASHDGGK QALETVQRLLPVLCQAHGLTPQQVVAIASNNGGKQALETVQRLLPVLCQAHGLTPQQV VAIASNNGGKQALETVQRLLPVLCQAHGLTPQQVVAIASNNGGKQALETVQRLLPVLCQ |

TABLE 3-continued

Polypeptide sequences of TALEN-reagents used in the examples

| Nickname | SEQ ID # | Target gene | TALEN (Left and Right heterodimers) | TALEN Polypeptide Sequence |
|---|---|---|---|---|
| | | | | AHGLTPEQVVAIASHDGGKQALETVQRLLPVLCQAHGLTPQQVVAIASNGGGKQALETV QRLLPVLCQAHGLTPQQVVAIASNNGGKQALETVQRLLPVLCQAHGLTPVLCQAHGLTV GGKQALETVQRLLPVLCQAHGLTPQQVVAIASNGGRPALESIVAQLSRPDPALAALTN DHIVALACLGGRPALDAVKKGLGDPISRSQLVKSELEEKKSELRHKLKYVPHEYIELIEIA RNSTQDRILEMKVMEFFMKVYGYRGKHLGGSRKPDGAIYTVGSPIDYGVIVDTKAYSGG YNLPIGQADEMQRYVEENQTRNKHINPNEWWKVYPSSVTEFKFLFVSGHFKGNYKAQL TRLNHITNCNGAVLSVEELLIGGEMIKAGTLTLEEVRRKFNNGEINFAAD |
| pCLS30875 | 102 | PTGER2 (Exon1) | ptger2_ex1-R1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPEQVVAIASHDGKQA LETVQRLLPVLCQAHGLTPEQVVAIASHDGGKQALETVQRLLPVLCQAHGLTPQVVAIA SHDGGKQALETVQRLLPVLCQAHGLTPQQVVAASNNGGKQALETVQRLLPVLCQAHG LTPEQVVAIASNIGGKQALETVQALLPVLCQAHGLTPQQVVAIASNNGGKQALETVQRLL PVLCQAHGLTPQQVVAIASHDGGKQALETVQRLLPVLCQAHGLTPEQVVAIASNIGGKQ ALETVQALLPVLCQAHGLTPQQVVAIASNNGGKQALETVQRLLPVLCQAHGLTPQQVVA IASNNGGKQALETVQRLLPVLCQAHGLTPQQVVAIASNGGKQALETVQRLLPVLCQAH GLTPEQVVAIASHDGGKQALETVQRLLPVLCQAHGLTPQQVVAIASNNGGKQALETVQR LLPVLCQAHGLTPQQVVAIASNNGKCIALETVQRLLPVLCQAHGLTPQQVVAIASNGGG KQALETVQRLLPVLCQAHGLTPQQVVAIASNGGRPALESIVAQLSRPDPALAALTNDH LVALACLGGRPALDAVKKGLGDPISRSQLVKSELEEKKSELRHKLKYVPHEYIELIEIARN STQDRILEMKVMEFFMKVYGYRGKHLGGSRKPDGAIYTVGSPIDYGVIVDTKAYSGYN LPIGQADEMQRYVEENQTRNKHINPNEWWKVYPSSVTEFKFLFVSGHFKGNYKAQLTR LNHITNCNGAVLSVEELLIGGEMIKAGTLTLEEVRRKFNNGEINFAAD |
| pCLS30876 | 103 | PTGER2 (Exon2) | ptger2_ex2-L1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNGGGKQ ALETVQRLLPVLCQAHGLTPQQVVAIASNGGGKQALETVQRLLPVLCQAHGLTPQQVVA IASNNGGKQALETVQRLLPVLCQAHGLTPEQVVAIASHDGGKQALETVQRLLPVLCQAH GLTPQQVVAIASNGGKQALETVQRLLPVLCQAHGLTPQQVVAIASNGGGKQALETVQ RLLPVLCQAHGLIPEQVVAIASHDGGKQALETVQRLLPVLCQAHGLTPQQVVAIASNGG GKQALETVQRLLPVLCQAHGLTPQQVVAIASNGGKQALETVQRLLPVLCQAHGLTPE QVVAIASNIGGKQALETVQALLPVLCQAHGLTPEQVVAIASHDGGKQALETVQRLLPVLC QAHGLIPEQVVAIASNIGGKQALETVQRLLPVLCQAHGLTPQQVVAIASNNGGKQALET VQRLLPVLCQAHGLTPEQVVAIASNIGGKQALETVQALLPVLCQAHGLTPQQVVAIASNG GKQALETVQRLLPVLCQAHGLTPQQVVAIASNGGRPALESIVAQLSRPDPALAALTN DHLVALACLGGRPALDAVKKGLGDPISRSQLVKSELEEKKSELRHKLKYVPHEYIELIEIA RNSTQDRILEMKVMEFFMKVYGYRGKHLGGSRKPDGAIYTVGSPIDYGVIVDTKAYSGG YNLPIGQADEMQRYVEENQTRNKHINPNEWWKVYPSSVTEFKFLFVSGHFKGNYKAQL TRLNHITNCNGAVLSVEELLIGGEMIKAGTLTLEEVRRKFNNGEINFAAD |
| pCLS30877 | 104 | PTGER2 (Exon2) | ptger2_ex2-R1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNGGGKQ ALETVQRLLPVLCQAHGLTPQQVVAIASNGGGKQALETVQRLLPVLCQAHGLTPEQVVA IASHDGKQALETVQRLLPVLCQAHGLTPQQVVAIASNNGGKQALETVQRLLPVLCQAH |

TABLE 3-continued

Polypeptide sequences of TALEN-reagents used in the examples

| Nickname | SEQ ID # | Target gene | TALEN (Left and Right heterodimers) | TALEN Polypeptide Sequence |
|---|---|---|---|---|
| | | | | GLTPQQVVAIASNNGGKQALETVQRLLPVLCQAHGLTPQQVVAIASNNGGKQALETVQ RLLPVLCQAHGLTPQQVVAIASNIGGKQALETVQALLPVLCQAHGLTPEQVVAIASNIGG KQALETVQALLPVLCQAHGLTPQQVVAIASNNGGKQALETVQRLLPVLCQAHGLTPEQV VAIASNIGGKQALETVQALLPVLCQAHGLTPQQVVAIASNNGGKQALETVQRLLPVLCQA HGLTPQQVVAIASNNGGKQALETVQRLLPVLCQAHGLTPQQVAIASNGGKQALETV QRLLPVLCQAHGLTPQQVVAIASNGGGKQALETVQRLLPVLCQAHGLTPQQVVAIASNG GKQALETVQRLLPVLCQAHGLTPQQWAIASNGGGRPALESIVAQLSRPDPALAALTN DHIVALACLGGRPALDAVKKGLGDPISRSQLVKSELEEKKSELRHKLKYVPHEYIELIEIA RNSTQDRILEMKVMEFFMKVYGYRGKHLGGSRKPDGAIYTVGSPIDYGVIVDTKAYSGG YNLPIGQADEMQRYVEENQTRNKHINPNEWWKVYPSSVTEFKFLFVSGHFKGNYKAQL TRLNHITNCNGAVLSVEELLIGGEMIKAGTLTLEEVRRKFNNGEINFAAD |
| pCLS30878 | 105 | ILT2 | ILT2_1-L1 | MGDPKKKRKVIDYPVDPDYAIDIADLRTLGYSQQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPEQVVAIASHDGGKQA LETVQRLLPVLCQAHGLTPEQVVAIASHDGGKQALETVQRLLPVLCQAHGLTPQQVVAI ASNGGKQALETVQRLLPVLCQAHGLTPQQVVAISNIGGKQALETVQRLLPVLCQAH GLTPEQVVAIASNGGKQALETVQRLLPVLCQAHGLTPQQVVAIASNGGKQALETVQR LLPVLCQAHGLTPQQVVAIASNGGKQALETVQRLLPVLCQAHGLTPQQVVAIASNGGG KQALETVQRLLPVLCQAHGLTPEQVVAIASHDGGKQALETVQRLLPVLCQAHGLTPEQV VAIASHDGGKQALETVQRLLPVLCQAHGLTPQQVVAIASNGGGKQALETVQRLLPVLCQ AHGLTPQQVVAIASHDGGKQALETVQRLLPVLCQAHGLTPEQVVAIASHDGGKQALETV QRLLPVLCQAHGLTPQQVVAIASHDGGKQALETVQRLLPVLCQAHGLTPEQVVAIASNIG GKQALETVQALLPVLCQAHGLTPQQVVAIASNGGGRPALESIVAQLSRPDPALAALTND HIVALACLGGRPALDAVKKGLGDPISRSQLVKSELEEKKSELRHKLKYVPHEYIELIEIAR NSTQDRILEMKVMEFFMKVYGYRGKHLGGSRKPDGAIYTVGSPIDYGVIVDTKAYSGGY NLPIGQADEMQRYVEENQTRNKHINPNEWWKVYPSSVTEFKFLFVSGHFKGNYKAQLT RLNHITNCNGAVLSVEELLIGGEMIKAGTLTLEEVRRKFNNGEINFAAD |
| pCLS30879 | 106 | ILT2 | ILT2_1-R1 | MGDPKKKRKVIDYPVDPDYAIDIADLRTLGYSQQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNGGGKQ ALETVQRLLPVLCQAHGLTPQQVVAIASHDGGKQALETVQRLLPVLCQAHGLTPEQVVAI ASNIGGKQALETVQALLPVLCQAHGLTPQQVVAIASNNGGKQALETVQRLLPVLCQAHG LTPEQVVAIASHDGGKQALETVQRLLPVLCQAHGLTPEQVVAIASHDGGKQALETVQRL LPVLCQAHGLTPQQVAIASHDGGKQALETVQRLLPVLCQAHGLTPEQVVAIASNIGGK QALETVQRLLPVLCQAHGLTPQQVVAIASNNGGKQALETVQRLLPVLCQAHGLTPEQVV AIASNIGGKQALETVQRLLPVLCQAHGLTPQQVVAIASNNGGKQALETVQRLLPVLCQAH GLTPQQVVAIASNGGKQALETVQRLLPVLCQAHGLTPQQVVAIASNNGGKQALETVQ RLLPVLCQAHGLTPQQVVAIASNGGGKQALETVQRLLPVLCQAHGLTPQQVVAIASNNG GKQALETVQRLLPVLCQAHGLTPQQVVAIASNGGGRPALESIVAQLSRPDPALAALTND HIVALACLGGRPALDAVKKGLGDPISRSQLVKSELEEKKSELRHKLKYVPHEYIELIEIAR NSTQDRILEMKVMEFFMKVYGYRGKHLGGSRKPDGAIYTVGSPIDYGVIVDTKAYSGGY NLPIGQADEMQRYVEENQTRNKHINPNEWWKVYPSSVTEFKFLFVSGHFKGNYKAQLT RLNHITNCNGAVLSVEELLIGGEMIKAGTLTLEEVRRKFNNGEINFAAD |

TABLE 3-continued

Polypeptide sequences of TALEN-reagents used in the examples

| Nickname | SEQ ID # | Target gene | TALEN (Left and Right heterodimers) | TALEN Polypeptide Sequence |
|---|---|---|---|---|
| pCLS30880 | 107 | ILT2 | ILT2_2-L1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTQGLLKIAKRGGVTAVEAVHAWRNALTGAPLNLTPQQVVAIASNNGGKQA LETVQRLLPVLCQAHGLTPQQVVAIASHDGKQALETVQRLLPVLCQAHGLTPQQVVAIA SNNGGKQALETVQRLLPVLCQAHGLTPEQVVAIASNIGGKQALETVQRLLPVLCQAHG LTPEQVVAIASNIGGKQALETVQALLPVLCQAHGLTPQQVVAIASNNGGKQALETVQRLL PVLCQAHGLTPEQVVAIASNIGGKQALETVQALLPVLCQAHGLTPEQVVAIASNIGGKQA LETVQALLPVLCQAHGLTPQQVVAIASNNGGKQALETVQRLLPVLCQAHGLTPQQVVAI ASNNGGKQALETVQRLLPVLCQAHGLTPQQVVAIASNNGGKQALETVQRLLPVLCQAH GLTPEQVVAIASHDGGKQALETVQRLLPVLCQAHGLTPQQVVAIASHDGGKQALETVQR LLPVLCQAHGLTPEQVVAIASNIGGKQALETVQALLPVLCQAHGLTPQQVVAIASNNGGK QALETVQRLLPVLCQAHGLTPQQVVAIASNGGGRPALESIVAQLSRPDPALAALTNDHL VALACLGGRPALDAVKKGLGDPISRSQLVKSELEKKSELRHKLKYVPHEYIELIEIARNS TQDRILEMKVMEFFMKVYGRKGHLGGSRKPDGAIYTVGSPIDYGVIVDTKAYSGGYNL PIGQADEMQRWEENQTRNKHINPNEWWKVYPSSVTEFKFLFVSGHFKGNYKAQLITRL NHITNCNGAVLSVEELLIGGEMIKAGTLITLEEVRRKFNNGEINFAAD |
| pCLS30881 | 108 | ILT2 | ILT2_2-R1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTQGLLKIAKRGGVTAVEAVHAWRNALTGAPLNLTPQQVVAIASNNGGKQA LETVQRLLPVLCQAHGLTPQQVVAIASNIGGKQALETVQRLLPVLCQAH ASNNGGKQALETVQRLLPVLCQAHGLTPQQVVAIASNGGGKQALETVQ GLTPQQVVAIASNNGGKQALETVQRLLPVLCQAHGLTPQQVVAIASNGGKQALETVQ RLLPVLCQAHGLTPQQVVAIASNGGKQALETVQRLLPVLCQAHGLTPEQVVAIASHDG GKQALETVQRLLPVLCQAHGLTPEQVVAIASHDGGKQALETVQRLLPVLCQAHGLTPEQ VVAIASHDCCKQALETVQRLLPVLCQAHGLTPEQVVAIASNIGGKQALETVQALLPVLCQ AHGLTPQQVVAIASNNGGKQALETVQRLLPVLCQAHGLTPQQVVAIASNNGGKQALETV QRLLPVLCQAHGLTPQQVVAIASNGGRPALESIVAQLSRPDPALAALTN DHLVALACLGGRPALDAVKKGLGDPISRSQLVKSELEKKSELRHKLKYVPHEYIELIEIA RNSTQDRILEMKVMEFFMKVYGYRGKHLGGSRKPDGAIYTVGSPIDYGVIVDTKAYSGG YNLPIGQADEMQRYVEENQTRNKHINPNEWWKVYPSSVTEFKFLFVSGHFKGNYKAQL TRLNHITNCNGAVLSVEELLIGGEMIKAGTLITLEEVRRKFNNGEINFAAD |
| pCLS30882 | 109 | ILT4 | ILT4_1-L1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTQGLLKIAKRGGVTAVEAVHAWRNALTGAPLNLTPQQVVAIASNNGGKQ ALETVQRLLPVLCQAHGLTPEQVVAIASHDGGKQALETVQRLLPVLCQAHGLTPQQVVA IASNGGKQALETVQRLLPVLCQAHGLTPQQVVAIASNIGGKQALETVQRLLPVLCQAH GLTPEQVVAIASNIGKQALETVQALLPVLCQAHGLTPEQVVAIASHDGGKQALETVQRL LPVLCQAHGLTIDEQVVAIASNGGKQALETVQALLPVLCQAHGLTPQQVVAIASNGGGK QALETVQRLLPVLCQAHGLTPQQVVAIASNNGGKQALETVQRLLPVLCQAHGLTPQQV VAIASNNGGKQALETVQRLLPVLCQAHGLTPQQVVAIASNNGGKQALETVQRLLPVLCQ AHGLTPEQVVAIASNIGGKQALETVQALLPVLCQAHGLIPEQVVAIASHDGGKQALETV QRLLPVLCQAHGLTPQQVVAIASNGGRPALESIVAQLSRPDPALAALTNDGGKQALETV GKQALETVQALLPVLCQAHGLTPQQVVAIASNGGRPALESIVAQLSRPDPALAALTND HLVALACLGGRPALDAVKKGLGDPISRSQLVKSELEKKSELRHKLKYVPHEYIELIEIAR |

TABLE 3-continued

Polypeptide sequences of TALEN-reagents used in the examples

| Nickname | SEQ ID # | Target gene | TALEN (Left and Right heterodimers) | TALEN Polypeptide Sequence |
|---|---|---|---|---|
| | | | | NSTQDRILEMKVMEFFMKVYGYRGKHLGGSRKPDGAIYTVGSPIDYGVIVDTKAYSGGY NLPIGQADEMQRYVEENQTRNKHINPNEWWKVYPSSVTEFKFLFVSGHFKGNYKAQLT RLNHITNCNGAVLSVEELLIGGEMIKAGTLTLEEVRRKFNNGEINFAAD |
| pCLS30883 | 110 | ILT4 | ILT4_1-R1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPIQLDTGQLLKIAKRGGVTAVEAVHAWRNALTGAPLNLTPQQVVAIASNNGGKQA LETVQRLLPVLCQAHGLTPEQVAIASHDGGKQALETVQRLLPVLCQAHGLTPQQVVAI ASNNGGKQALETVQRLLPVLCQAHGLTPQQVVAIASNNGGKQALETVQRLLPVLCQAH GLTPQQVVAIASNNGGKQALETVQRLLPVLCQAHGLTPEQVVAIASHDGGKQALETVQ RLLPVLCQAHGLTPQQVVAIASNGGGKQALETVQRLLPVLCQAHGLTPQQVVAIASNGG GKQALETVQRLLPVLCQAHGLTPEQVVAIASHDGGKQALETVQRLLPVLCQAHGLTPEQ VVAIASNIGGKQALETVQALLPVLCQAHGLTPEQVVAIASHDGGKQALETVQRLLPVLCQ AHGLTPEQVVAIASHDGGKQALETVQRLLPVLCQAHGLTPQQVVAIASHDGGKQALETV QRLLPVLCQAHGLTPQQVVAIASNIGGKQALETVQALLPVLCQAHGLTPQQVVAIASNNG GKQALETVQRLLPVLCQAHGLTPQQVVAIASNGGRPALESIVAQLSRPDPALAALTND HLVALACLGGRPALDAVKKGLGDPISRSQLVKSELEEKKSELRHKLKYVPHEYIELIEIAR NSTQDRILEMKVMEFFMKVYGYRGKHLGGSRKPDGAIYTVGSPIDYGVIVDTKAYSGGY NLPIGQADEMQRYVEENQTRNKHINPNEWWKVYPSSVTEFKFLFVSGHFKGNYKAQLT RLNHITNCNGAVLSVEELLIGGEMIKAGTLTLEEVRRKFNNGEINFAAD |
| pCLS30884 | 111 | ILT4 | ILT4_2-L1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPIQLDTGQLLKIAKRGGVTAVEAVHAWRNALTGAPLNLTPQQVVAIASNNGGKQA LETVQRLLPVLCQAHGLTPEQVVAIASHDGGKQALETVQRLLPVLCQAH ASNNGGKQALETVQRLLPVLCQAHGLTPEQVAIASHDGGKQALETVQRLLPVLCQAH GLTPQQVVAIASNNGGKQALIPEQVVAIASNIGGKQALETVQALLPVLCQAHGLTPQQV RLLPVLCQAHGLTPEQVVAIASNIGGKQALETVQALLPVLCQAHGLTPQQVVAIASNNGG KQALETVQRLLPVLCQAHGLTPEQVVAIASNIGGKQALETVQALLPVLCQAHGLTPQQV VAIASNNGGKQALETVQRLLPVLCQAHGLTPQQVVAIASNNGGKQALETVQRLLPVLCQ AHGLTPQQVVAIASNNGGKQALETVQRLLPVLCQAHGLTPQQVVAIASNGGGKQALET VQRLLPVLCQAHGLTPQQVVAIASNNGGKQALETVQRLLPVLCQAHGLTPQQVVAIASN NGGKQALETVQRLLPVLCQAHGLTPQQVVAIASNGGRPALESIVAQLSRPDPALAALT NDHLVALACLGGRPALDAVKKGLGDPISRSQLVKSELEEKKSELRHKLKVPHFYIELIEI ARNSTQDRILEMKVMEFFMKVYGYRGKHLGGSRKPDGAIYTVGSPIDYGVIVDTKAYSG GYNLPIGQADEMQRYVEENQTRNKHINPNEWWKVYPSSVTEFKFLFVSGHFKGNYKAQ LTRLNHITNCNGAVLSVEELLIGGEMIKAGTLTLEEVRRKFNNGEINFAAD |
| pCLS30885 | 112 | ILT4 | ILT4_2-R1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPIQLDTGQLLKIAKRGGVTAVEAVHAWRNALTGAPLNLTPQQVVAIASNNGGKQA LETVQRLLPVLCQAHGLTPEQVVAIASHDGGKQALETVQRLLPVLCQAHGLTPEQVVAIA SHDGGKQALETVQRLLPVLCQAHGLTPQQVVAIASNGGGKQALETVQRLLPVLCQAHG LTPEQVVAIASHDGGKQALETVQRLLPVLCQAHGLTPEQVVAIASHDGGKQALETVQRL LPVLCQAHGLTPQQVVAIASNGGGKQALETVQRLLPVLCQAHGLTPQQVVAIASNGGG KQALETVQRLLPVLCQAHGLTPEQVVAIASHQGGKQALETVQRLLPVLCQAHGLTPQQV VAIASNGGGKQALETVQRLLPVLCQAHGLTPEQVVAIASHDGGKQALETVQRLLPVLCQ |

TABLE 3-continued

Polypeptide sequences of TALEN-reagents used in the examples

| SEQ ID # | Target gene | Nickname | TALEN (Left and Right heterodimers) | TALEN Polypeptide Sequence |
|---|---|---|---|---|
| | | | | AHGLTPQQVVAIASNGGGKQALETVQRLLPVLCQAHGLTPEQVVAIASHDGKQALETV QRLLPVLCQAHGLTPQQVVAIASHDGKQALETVQRLLPVLCQAHGLTPEQVVAIASNG GGKQALETVQRLLPVLCQAHGLTPQQVVAIASNGGGRPALESIVAQLSRPDPALAALTN DHIVALACLGGRPALDAVKKGLGDPISRSQLVKSELEEKKSELRHKLKYVPHEYIELIEIA RNSTQDRILEMKVMEFFMKVYGYRGKHLGGSRKPDGAIYTVGSPIDYGVIVDTKAYSGG YNLPIGQADEMQRYVEENQTRNKHINPNEWWKVYPSSVTEFKFLFVSGHFKGNYKAQL TRLNHITNCNGAVLSVEELLIGGEMIKAGTLTLEEVRRKFNNGEINFAAD |
| 113 | STAT3 | pCLS30886 | STAT3_1-L1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNNGGKQA LETVQRLLPVLCQAHGLTPQQVVAIASNGGGKQALETVQRLLPVLCQAHGLTPQQVVAI ASNNGGKQCALETVQRLLPVLCQAHGLTPEQVVAIASNIGGKQALETVQRLLPVLCQAHG LTPEQVVAIASHDGKQALETVQRLLPVLCQAHGLTPQQVVAIASHDGKQALETVQRL LPVLCQAHGLTPEQVVAIASHDGKQALETVQRLLPVLCQAHGLTPEQVVAIASHDGGK QALETVQRLLPVLCQAHGLTPQQVVAIASNGGGKQALETVQRLLPVLCQAHGLTPQQV VAIASNNGGKQALETVQRLLPVLCQAHGLTPEQVVAIASNIGGKQALETVQALLPVLCQA HGLTPQQVVAIASHDGKQALETVQRLLPVLCQAHGLTPQQVVAIASNGGGKQALETV QRLLPVLCQAHGLTPQQVVAIASNGGGKQALETVQRLLPVLCQAHGLTPQQVVAIASNG GGKQALETVQRLLPVLCQAHGLTPQQVVAIASNGGGRPALESIVAQLSRPDPSGSGSG GDPISRSQLVKSELEEKKSELRHKLKYVPHEYIELIEARNSTQDRILEMKVMEFFMKVYG YRGKHLGGSRKPDGAIYTVGSPIDYGVIVDTKAYSGGYNLPIGQADEMQRYVEENQTRN KHINPNEWWKVYPSSVTEFKFLFVSGHFKGNYKAQLTRLNHITNCNGAVLSVEELLIGG EMIKAGTLTLEEVRRKFNNGEINFAAD |
| 114 | STAT3 | pCLS30887 | STAT3_1-R1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASNNGGKQA LETVQRLLPVLCQAHGLTPQQVVAIASNIGGKQALETVQRLLPVLCQAHGLTPEQVVAI ASNIGGKQALETVQALLPVLCQAHGLTPQQVVAIASNGGKQALETVQRLLPVLCQAHG LTPEQVVAIASHDGKQALETVQRLLPVLCQAHGLTPQQVVAIASNGGGKQALETVQRL LPVLCQAHGLTPQQVVAIASNNGGKQALETVQRLLPVLCQAHGLTPEQVVAIASNIGGK QALETVQALLPVLCQAHGLTPQQVVAIASHDGGKQALETVQRLLPVLCQAHGLTPQQV VAIASNNGGKQALETVQRLLPVLCQAHGLTPEQVVAIASHDGKQALETVQRLLPVLCQ AHGLTPEQVVAIASHDGGKQALETVQRLLPVLCQAHGLTPEQVVAIASNIGGKQALETV QALLPVLCQAHGLTPQQVVAIASNGGGKQALETVQRLLPVLCQAHGLTPQQVVAIASNG GGKQALETVQRLLPVLCQAHGLTPQQVVAIASNGGGRPALESIVAQLSRPDPSGSGSG GDPISRSQLVKSELEEKKSELRHKLKYVPHEYIELIEIARNSTQDRILEMKVMEFFMKVYG YRGKHLGGSRKPDGAIYTVGSPIDYGVIVDTKAYSGGYNLPIGQADEMQRYVEENQTRN KHINPNEWWKVYPSSVTEFKFLFVSGHFKGNYKAQLTRLNHITNCNGAVLSVEELLIGG EMIKAGTLTLEEVRRKFNNGEINFAAD |
| 115 | STAT3 | pCLS30888 | STAT3_2-L1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAVEAVHAWRNALTGAPLNLTPQQVVAIASHDGGKQA LETVQRLLPVLCQAHGLTPQQVVAIASNNGGKQALETVQRLLPVLCQAH |

TABLE 3-continued

Polypeptide sequences of TALEN-reagents used in the examples

| Nickname | SEQ ID # | Target gene | TALEN (Left and Right heterodimers) | TALEN Polypeptide Sequence |
|---|---|---|---|---|
| | | | | GLTPEQVVAIASHDGGKQALETVQRLLPVLCQAHGLTPEQVVAIASHDGGKQALETVQR LLPVLCQAHGLTPEQVVAIASHDGGKQALETVQRLLPVLCQAHGLTPEQVVAIASHDGG KQALETVQRLLPVLCQAHGLTPQQVVAIASNGGGKQALETVQRLLPVLCQAHGLTPQQ VVAIASNGGGKQALETVQRLLPVLCQAHGLTPQQVVAIASNNGGKQALETVQRLLPVLC QAHGLTPQQVVAIASNNGGKQALETVQRLLPVLCQAHGLTPEQVVAIASNIGGKQALET VQALLPVLCQAHGLTPQQVVAIASNNGGKQALETVQRLLPVLCQAHGLTPQQVVAIASN GGGKQALETVQRLLPVLCQAHGLTPQQVVAIASNGGRPALESIVAQLSRPDPSGSGS GGDPISRSQLVKSELEEKKSELRHKLKYVPHEYIELIEIARNSTQDRILEMKVMEFFMKVY GYRGKHLGGSRKPDGAIYTVGSPIDYGVIVDTKAYSGGYNLPIGQADEMQRYVEENQT RNKHINPNEWWKVYPSSVTEFKFLFVSGHFKGNYKAQLTRLNHITNCNGAVLSVEELLI GGEMIKAGTLTLEEVRRKFNNGEINFAAD |
| pCLS30889 | 116 | STAT3 | STAT3_2-R1 | MGDPKKKRKVIDYPYDVPDYAIDIADLRTLGYSQQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAEVAHAWRNALTGAPLNLTPQQVVAIASNGGGKQ ALETVQRLLPVLCQAHGLTPEQVVAIASNIGGKQALETVQALLPVLCQAHGLTPEQVVAI ASNIGGKQALETVQALLPVLCQAHGLTPQQVVAIASNNGGKQALETVQRLLPVLCQAHG LTPEQVVAIASNIGGKQALETVQALLPVLCQAHGLTPEQVVAIASNIGGKQALETVQALLP VLCQAHGLTPQQVVAIASNNGGKQALETVQRLLPVLCQAHGLTPQQVVAIASNNGGKQ ALETVQRLLPVLCQAHGLTPQQVVAIASNNGGKQALETVQRLLPVLCQAHGLTPEQVVAI ASHDGGKCALETVQRLLPVLCQAHGLTPEQVVAIASNNGGKQALETVQRLLPVLCQAH GLTPQQVVAIASNGGGKQALETVQRLLPVLCQAHGLTPEQVVAIASNIGGKQALETVQA LLPVLCQAHGLTPEQVVAIASHDGGKQALETVQRLLPVLCQAHGLTPEQVVAIASHDGG KQALETVQRLLPVLCQAHGLTPQQVVAIASNGGRPALESIVAQLSRPDPSGSGSGGD PISRSQLVKSELEEKKSELRHKLKYVPHEYIELIEIARNSTQDRILEMKVMEFFMKVYGYR GKHLGGSRKPDGAIYTVGSPIDYGVIVDTKAYSGGYNLPIGQADEMQRYVBENQTRNKH INPNEWWKVYPSSVTEFKFLFVSGHFKGNYKAQLTRLNHITNCNGAVLSVEELLIGGEMI KAGTLTLEEVRRKFNNGEINFAAD |
| pCLS30890 | 117 | MT1A | Mt1A_ex2_1-L1 | MGDPKKKRKVIDYPYDVPDYAIDIADLRTLGYSQQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGGVTAEVAHAWRNALTGAPLNLTPQQVVAIASHDGGKQA LETVQRLLPVLCQAHGLTPQQVVAIASNGGGKQALETVQRLLPVLCQAHGLTPQQVVAI ASNGGGKQALETVQRLLPVLCQAHGLTPEQVVAIASHDGGKQALETVQRLLPVLCQAH GLTPQQVVAIASHDGGKQALETVQRLLPVLCQAHGLTPQQVVAIASNGGGKQALETVQ RLLPVLCQAHGLTPQQVVAIASNGGGKQALETVQRLLPVLCQAHGLTPQQVVAIASNNG GKQALETVQRLLPVLCQAHGLTPEQVVAIASHDGGKQALETVQRLLPVLCQAHGLTPEQ VVAIASNIGGKQALETVQALLPVLCQAHGLTPQQVVAIASNNGGKQALETVQRLLPVLCQ AHGLTPQQVVAIASNNGGKQALETVQRLLPVLCQAHGLTPQQVVAIASNGGGKQALET VQRLLPVLCQAHGLTPQQVVAIASNNGGKQALETVQRLLPVLCQAHGLTPQQVVAIASN NGGKQALETVQRLLPVLCQAHGLTPQQVVAIASNGGRPALESIVAQLSRPDPSGSGS GGDPISRSQLVKSELEEKKSELRHKLKYVPHEYIELIEIARNSTQDRILEMKVMEFFMKVY GYRGKHLGGSRKPDGAIYTVSSPIDYGVIVDTKAYSGGYNLPIGQADEMQRYVEENQT RNKHINPNEWWKVYPSSVTEFKFLFVSGHFKGNYKAQLTRLNHITNCNGAVLSVEELLI GGEMIKAGTLTLEEVRRKFNNGEINFAAD |

TABLE 3-continued

Polypeptide sequences of TALEN-reagents used in the examples

| Nickname | SEQ ID # | Target gene | TALEN (Left and Right heterodimers) | TALEN Polypeptide Sequence |
|---|---|---|---|---|
| pCLS30891 | 118 | MT1A | Mt1A_ex2_1-R1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGVTAVEAVHAWRNALTGAPLNLTPQQVVAIASNGGGKQ ALETVQRLLPVLCQAHGLTPQQVVAIASNNGGKQALETVQRLLPVLCQAHGLTPQQVVA IASNNGGKQALETVQRLLPVLCQAHGLTPEQVVAIASHDGGKQALETVQRLLPVLCQAH GLTPEQVVAIASNIGGKQALETVQALLPVLCQAHGLTPQQVVAIASNNGGKQALETVQR LLPVLCQAHGLTPQQVVAIASNNGGKQALETVQRLLPVLCQAHGLTPEQVVAIASNIGGK QALETVQALLPVLCQAHGLTPQQVVAIASNNGGKQALETVQRLLPVLCQAHGLTPEQVV AIASHDGGKQALETVQRLLPVLCQAHGLTPEQVVAIASHDGGKQALETVQRLLPVLCQA HGLTPEQVVAIASNIGGKQALETVQALLPVLCQAHGLTPQQVVAIASNNGGKQALETVQ RLLPVLCQAHGLTPQQVVAIASNGGGKQALETVQRLLPVLCQAHGGRPALESIVAQLSRPDPSGSGSGG DPISRSQLVKSELEEKKSELRHKLKYVPHEYIELIEIARNSTQDRILEMKVMEFFMKVYGY RGKHLGGSRKPDGAIYTVGSPIDYGVIVDTKAYSGGYNLPIGQADEMQRYVEENQTRNK HINPNEWWKVYPSSVTEFKFLFVSGHPFKGNYKAQLTRLNHITNQNGAVLSVEELLIGEE MIKAGTLTLEEVRRKFNNGEINFAAD |
| pCLS30892 | 119 | MT1A | Mt1A_ex2_2-L1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGVTAVEAVHAWRNALTGAPLNLTPQQVVAIASNNGGKQA LETVQRLLPVLCQAHGLTPEQVVAIASHDGGKQALETVQRLLPVLCQAHGLTPEQVVAIA SNIGGKQALETVQALLPVLCQAHGLTPEQVVAIASNGGKQALETVQLLPVLCQAHGLT PEQVVAIASNGGKQALETVQRLLPVLCQAHGLTPEQVVAIASHDGGKQALETVQRLLP VLCQAHGLTPQQVVAIASNNGGKQALETVQRLLPVLCQAHGLTPEQVVAIASHDGGKQ ALETVQRLLPVLCQAHGLTPEQVVAIASNIGGKQALETVQRLLPVLCQAHGLTPEQVVAI ASHDGGKQALETVQRLLPVLCQAHGLTPEQVVAIASHDGGKQALETVQRLLPVLCQAH GLTPQQVVAIASNGGGKQALETVQRLLPVLCQAHGLTPEQVVAIASHDGGKQALETVQ RLLPVLCQAHGLTPQQVVAIASNGGKQALETVQRLLPVLCQAHGGRPALESIVAQLSRPDPSGSGSGG DPISRSQLVKSELEEKKSELRHKLKYVPHEYIELIEIARNSTQDRILEMKVMEFFMKVYGY RGKHLGGSRKPDGAIYTVGSPIDYGVIVDTKAYSGGYNLPIGQADEMQRYVEENQTRNK HINPNEWWKVYPSSVTEFKFLFVSGHPFKGNYKAQLTRLNHITNQNGAVLSVEELLIGEE MIKAGTLTLEEVRRKFNNGEINFAAD |
| pCLS30893 | 120 | MT1A | Mt1A_ex2_2-R1 | MGDPKKKRKVIDYPYDVPDYAIDIADLRTLGYSQQQEKIKPKVRSTVAQHHEALVGHG FTHAHIVALSQHPAALGTVAVKYQDMIAALPEATHEAIVGVGKQWSGARALEALLTVAGE LRGPPLQLDTGQLLKIAKRGVTAVEAVHAWRNALTGAPLNLTPQQVVAIASNNGGKQA LETVQRLLPVLCQAHGLTPQQVVAIASNNGGKQALETVQRLLPVLCQAHGLTPEQVVAI ASNNGGKQALETVQRLLPVLCQAHGLTPQQVVAIASNGGKQALETVQRLLPVLCQAHG LTPEQVVAIASNIGGKQALETVQRLLPVLCQAHGLTPQQVVAIASNGGKQALETVQRLL PVLCQAHGLTPVLCQAHGLTPEQVVAIASHDGGKQALETVQRLLPVLCQAHGLTPEQVV QALETVQRLLPVLCQAHGLTPEQVVAIASHDGGKQALETVQRLLPVLCQAHGLTPEQVV AIASHDGGKQALETVQRLLPVLCQAHGLIPEQVVAIASHDGGKGALETVQRLLPVLCQA |

TABLE 3-continued

Polypeptide sequences of TALEN-reagents used in the examples

| Nickname | SEQ ID # | Target gene | TALEN (Left and Right heterodimers) | TALEN Polypeptide Sequence |
|---|---|---|---|---|
| | | | | HGLTPEQVVAIASHDGGKQALETVQRLLPVLCQAHGLTPEQVVAIASNIGGKQALETVQ ALLPVLCQAHGLTPEQVVAIASHDGGKQALETVQRLLPVLCQAHGLTPEQVVAIASNIGG KQALETVQALLPVLCQAHGLTPQQVVAIASNGGGRPALESIVAQLSRPDPSGSGSGGD PISRSQLVKSELEEKKSELRHKLKYVPHEYIELIEIARNSTQDRILEMKVMEFFMKVYGYR GKHLGGSRKPDGAIYTVGSPIDYGVIVDTKAYSGGYNLPIGQADEMQRYVEENQTRNKH INPNEWWKVYPSSVTEFKFLFVSGHPFKGNYKAQLTRLNHITNCNGAVLSVEELLIGGEMI KAGTLTLEEVRRKFNNGEINFAAD |

The following assays were performed to assess the potency of the engineered immune cells and compare their immune function with respect to mock transfected T-cells:

Proliferation Assay Upon T-Cell Activation:

TALEN-treated and control T cells were labeled with CFSE and reactivated using anti-CD3/CD28 beads. 3 days later, cells were analyzed by flow cytometry and proliferation was estimated by measuring the frequency of CFSE-low cells. The results show that cells treated with TALEN against RICTOR, PEA-15, SHARPIN, MIR21 or SEMA7A had improved cell proliferation compared to control cells.

In Vitro Alloreactivity:

TALEN-treated and control T cells were labeled with CFSE and used in a mixed lymphocyte reaction assay by incubating them with irradiated PBMCs obtained from an unrelated donor (at a 1 to 1 cellular ratio). 6 days later, cells were analyzed by flow cytometry and proliferation was estimated by measuring the frequency of CFSE-low cells among live cells. Supernatant were used to measure interferon gamma concentration. The results show that cells treated with TALEN against JAK2 or AURKA have reduced proliferation and reduced interferon gamma secretion and therefore reduced alloreactivity.

In Vivo Xenogenic GVHD:

20 million TALEN-treated and control T cells were injected into irradiated NSG mice. Body weight and survival were followed daily for 6 weeks. The results demonstrate that mice treated with JAK2neg or AURKAneg cells showed reduced GVHD symptoms compared to mice treated control cells.

Sensitivity to HLA-G Inhibition:

As described in Ketroussi et al. (PLoS One. 2011; 6(8): e22776), T cells were stimulated with OKT3/IL2 and treated with HLA-G beads or control beads and proliferation was measured by labeling T cells with CFSE before the assay and 3 days later by measuring by flow cytometry the frequency of CFSE-low cells. The sensitivity to HLA-G is estimated by the diminution of proliferation in cells treated with HLA-G beads compared to control beads. Our results show that cells treated with ILT2 or ILT4-specific TALEN had improved proliferation in the presence of HLA-G compared to control treated cells.

Exhaustion Assays:

TALEN-treated or control cells were stimulated with anti-CD3/CD28 beads every 3 days. After 5 repeated stimulation, cells were analyzed by flow cytometry for the expression of TIM3, LAG3, PD1 and the culture supernatant was analyzed for the concentration of IL-2. Cells treated with TALEN against, DNMT3A, miR31, MT1A or MT2A showed increased secretion of IL-2 compared to control cells. Cells treated with TALEN against STAT1, STAT3 or IL27RA showed decreased frequency of PD1+TIM3+ LAG3+ cells.

Glucose Metabolism:

TALEN-treated or control cells were labeled with CFSE and stimulated with anti-CD3/CD28 beads in the presence of varying concentration of glucose. Five days later, the proliferation capacity of T cells was estimated by measuring by flow cytometry the frequency of CFSE-low cells. The results demonstrate that cells treated with TALEN against BCAT1, SERCA3, MIR101 or MIR26A1 maintain better proliferation capacity at low glucose level (representing a competitive metabolic environment such as that of a tumor) than control cells in which proliferation is weakened by low glucose levels.

SEQUENCE LISTING (120 sequences)

SEQ ID NO: 1 - DNA, 47 bp, Homo sapiens
  miR21_1
tgtaccaccttgtcgggtagcttatcagactgatgttgactgttgaa

SEQ ID NO: 2 - DNA, 50 bp, Homo sapiens
  miR21_2
taccaccttgtcgggtagcttatcagactgatgttgactgttgaatctca

SEQ ID NO: 3 - DNA, 48 bp, Homo sapiens
  miR31_1
tgtaacttggaactggagaggaggcaagatgctggcatagctgttgaa

SEQ ID NO: 4 - DNA, 48 bp, Homo sapiens
  miR31_2
ttggaactggagaggaggcaagatgctggcatagctgttgaactggga

SEQ ID NO: 5 - DNA, 49 bp, Homo sapiens
  STAT1_1
ttccctataggatgtctcagtggtacgaacttcagcagcttgactcaaa

SEQ ID NO: 6 - DNA, 49 bp, Homo sapiens
  STAT1_2
tgtctcagtggtacgaacttcagcagcttgactcaaaattcctggagca

SEQ ID NO: 7 - DNA, 47 bp, Homo sapiens
  26A1_1
tggcgaaggccgtggcctcgttcaagtaatccaggataggctgtgca

SEQ ID NO: 8 - DNA, 50 bp, Homo sapiens
  26A1_2
tccaggataggctgtgcaggtcccaatgggcctattcttggttacttgca

SEQ ID NO: 9 - DNA, 48 bp, Homo sapiens
  miR101_1
tccttcagttatcacagtactgtacctttagaatagacagcatcagca

SEQ ID NO: 10 - DNA, 48 bp, Homo sapiens
  miR101_2
tggctgccatccttcagttatcacagtactgtacctttagaatagaca

SEQ ID NO: 11 - DNA, 49 bp, Homo sapiens
  mt2a_exon1
tcccaactgctcctgcgccgccggtaagaggctggggatgcccagtgta

SEQ ID NO: 12 - DNA, 49 bp, Homo sapiens
  mt2a_exon2
tccttgcaggtgactcctgcacctgcgccggctcctgcaaatgcaaaga

SEQ ID NO: 13 - DNA, 45 bp, Homo sapiens
  STAT3_1
tgggacccctgattttagcaggatggcccaatggaatcagctaca

SEQ ID NO: 14 - DNA, 45 bp, Homo sapiens
  STAT3_2
tctggccccttggattgagagtcaagattggtaagtccttcttaa

SEQ ID NO: 15 - DNA, 44 bp, Homo sapiens
  Mt1A_ex2_1
tcttccttgcaggtggctcctgcacctgcactggctcctgcaaa

SEQ ID NO: 16 - DNA, 46 bp, Homo sapiens
  Mt1A_ex2_2
tgcaaatgcacctcctgcaagaagagtgagtgtggggccatctcca

SEQ ID NO: 17 - DNA, 49 bp, Homo sapiens
  hsJAK2_1
tccagttcttcaggtgtatctttaccattcccttgggaaatctgaggca

SEQ ID NO: 18 - DNA, 49 bp, Homo sapiens
  hsJAK2_2
tgaggcagattatctgacctttccatctggggagtatgttgcagaagaa

SEQ ID NO: 19 - DNA, 49 bp, Homo sapiens
  hsAURKA_1
tgactcagcaatttccttgtcagaatccattacctgtaaatagtggcca

SEQ ID NO: 20 - DNA, 49 bp, Homo sapiens
  hsAURKA_2
ttgtctccagtcacaagccggttcagaatcagaagcagaagcaattgca

SEQ ID NO: 21 - DNA, 49 bp, Homo sapiens
  ptger2_ex1
ttgttccacgtgctggtgaccgagctggtgttcaccgacctgctcggga

SEQ ID NO: 22 - DNA, 49 bp, Homo sapiens
  ptger2_ex2
tttgcttcttacagatttttgcatatatgaatgaaacctcttcccgaaa

SEQ ID NO: 23 - DNA, 49 bp, Homo sapiens
  ILT2_1
tcctgatttccttccagggcacctccccaagcccaccctctgggctgaa

SEQ ID NO: 24 - DNA, 49 bp, Homo sapiens
  ILT2_2
tgtgaagaagggccagttccccatcccatccatcacctgggaacacaca

SEQ ID NO: 25 - DNA, 49 bp, Homo sapiens
  ILT4_1
ttctcacctgggaccaggagctccaggagatcactgggtgaagaccaca

SEQ ID NO: 26 - DNA, 49 bp, Homo sapiens
  ILT4_2
tgggctgagagggtgggttttgggtaggctcctaggagagaaggaggca

SEQ ID NO: 27 - DNA, 49 bp, Homo sapiens
  DNMT3A.1
tggaggaatgtgccaaaactgcaaggtaggagcacacccacccaggaga

SEQ ID NO: 28 - DNA, 49 bp, Homo sapiens
  DNMT3A.2
tgggtggaacctgaggcagctgcctacgcaccacctccaccagccaaaa

SEQ ID NO: 29 - DNA, 49 bp, Homo sapiens
  IL27RAex1.1
tgtgggtgcttttccagcggacgcgtccccagggtgagtgctggaggga

SEQ ID NO: 30 - DNA, 49 bp, Homo sapiens
  IL27RAex2.1
ttggggacctgggagccccctccgagttacacctccagagccaaaagta

SEQ ID NO: 31 - DNA, 49 bp, Homo sapiens
  IL27RAex5_1.1
tacccctgacccctgttgagatccaagatttggagctagccactggcta

SEQ ID NO: 32 - DNA, 49 bp, Homo sapiens
  IL27RAex5_2.1
tgggcttgccctcaatccacgcccctcccacccccagaagtctgtccaa

SEQ ID NO: 33 - DNA, 49 bp, Homo sapiens
  PEA-15_ex1.1
tgcaagacctgaccaacaacatcacccttgaagatctagaacagctcaa

SEQ ID NO: 34 - DNA, 49 bp, Homo sapiens
  PEA-15_ex2.1
tcctgccttcctccagacaacctctcctacattgagcacatctttgaga

SEQ ID NO: 35 - DNA, 49 bp, Homo sapiens
  Sema7a_1.1
tgcggctgctgctgctgctctgggcggccgccgcctccgcccagggcca

SEQ ID NO: 36 - DNA, 49 bp, Homo sapiens
  Sema7a_ex2.1
ttgtctcctcctcaggccatgtagggcaggaccgggtggactttggcca

SEQ ID NO: 37 - DNA, 49 bp, Homo sapiens
  Sharpin_ex2_1.1
tcttctcaggttaatttggagtggcccctggagtcagtttcctacacca

SEQ ID NO: 38 - DNA, 49 bp, Homo sapiens
  Sharpin_ex3.1
tatcttacctctaggcagcaagagcaactcaccaccagccttgggccca

SEQ ID NO: 39 - DNA, 49 bp, Homo sapiens
  bcat1_ex3_1.1
tttcttccccaggctaaagacctaatagtcacaccagctaccattttaa

SEQ ID NO: 40 - DNA, 49 bp, Homo sapiens
  bcat1_ex4.1
ttgatctccagttatttgaaggattgaaggcatttcgaggagtagataa

SEQ ID NO: 41 - protein, 936 aa, artificial sequence
  bcat1_ex3_1-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 42 - protein, 936 aa, artificial sequence
  bcat1_ex3_1-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 43 - protein, 936 aa, artificial sequence
  bcat1_ex4-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 44 - protein, 936 aa, artificial sequence
  bcat1_ex4-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 45 - protein, 936 aa, artificial sequence
  DNMT3A-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 46 - protein, 936 aa, artificial sequence
  DNMT3A-L2
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 47 - protein, 936 aa, artificial sequence
  DNMT3A-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 48 - protein, 936 aa, artificial sequence
  DNMT3A-R2
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 49 - protein, 936 aa, artificial sequence
  IL27RAex1-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 50 - protein, 936 aa, artificial sequence
  IL27RAex1-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 51 - protein, 936 aa, artificial sequence
  IL27RAex2-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 52 - protein, 936 aa, artificial sequence
  IL27RAex2-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 53 - protein, 936 aa, artificial sequence
  IL27RAex5_1-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 54 - protein, 936 aa, artificial sequence
  IL27RAex5_1-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 55 - protein, 936 aa, artificial sequence
  IL27RAex5_2-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 56 - protein, 936 aa, artificial sequence
  IL27RAex5_2-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 57 - protein, 936 aa, artificial sequence
  PEA-15_ex1-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 58 - protein, 936 aa, artificial sequence
  PEA-15_ex1-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 59 - protein, 936 aa, artificial sequence
  PEA-15_ex2-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 60 - protein, 936 aa, artificial sequence
  PEA-15_ex2-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 61 - protein, 936 aa, artificial sequence
  Sema7a_1-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 62 - protein, 936 aa, artificial sequence
  Sema7a_1-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 63 - protein, 936 aa, artificial sequence
  Sema7a_ex2-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 64 - protein, 936 aa, artificial sequence
  Sema7a_ex2-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 65 - protein, 936 aa, artificial sequence
  Sharpin_ex2_1-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 66 - protein, 936 aa, artificial sequence
  Sharpin_ex2_1-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 67 - protein, 936 aa, artificial sequence
  Sharpin_ex3-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 68 - protein, 936 aa, artificial sequence
  Sharpin_ex3-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 69 - protein, 936 aa, artificial sequence
  miR21_1-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 70 - protein, 936 aa, artificial sequence
  miR21_1-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 71 - protein, 936 aa, artificial sequence
  miR21_2-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 72 - protein, 936 aa, artificial sequence
  miR21_2-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 73 - protein, 936 aa, artificial sequence
  miR31_1-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 74 - protein, 936 aa, artificial sequence
  miR31_1-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 75 - protein, 936 aa, artificial sequence
  miR31_2-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 76 - protein, 936 aa, artificial sequence
  miR31_2-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 77 - protein, 936 aa, artificial sequence
  STAT1_1-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 78 - protein, 936 aa, artificial sequence
  STAT1_1-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 79 - protein, 936 aa, artificial sequence
  STAT1_2-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 80 - protein, 936 aa, artificial sequence
  STAT1_2-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 81 - protein, 936 aa, artificial sequence
  26A1_1-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 82 - protein, 936 aa, artificial sequence
  26A1_1-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 83 - protein, 936 aa, artificial sequence
  26A1_2-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 84 - protein, 936 aa, artificial sequence
  26A1_2-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 85 - protein, 936 aa, artificial sequence
  miR101_1-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 86 - protein, 936 aa, artificial sequence
  miR101_1-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 87 - protein, 936 aa, artificial sequence
  miR101_2-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 88 - protein, 936 aa, artificial sequence
  miR101_2-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 89 - protein, 936 aa, artificial sequence
  mt2a_exon1-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 90 - protein, 936 aa, artificial sequence
  mt2a_exon1-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 91 - protein, 936 aa, artificial sequence
  mt2a_exon2-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 92 - protein, 936 aa, artificial sequence
  mt2a_exon2-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 93 - protein, 936 aa, artificial sequence
  hsJAK2_1-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 94 - protein, 936 aa, artificial sequence
  hsJAK2_1-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 95 - protein, 936 aa, artificial sequence
  hsJAK2_2-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 96 - protein, 936 aa, artificial sequence
  hsJAK2_2-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 97 - protein, 936 aa, artificial sequence
  hsAURKA_1-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 98 - protein, 936 aa, artificial sequence
  hsAURKA_1-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 99 - protein, 936 aa, artificial sequence
  hsAURKA_2-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 100 - protein, 936 aa, artificial sequence
  hsAURKA_2-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 101 - protein, 936 aa, artificial sequence
  ptger2_ex1-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 102 - protein, 936 aa, artificial sequence
  ptger2_ex1-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 103 - protein, 936 aa, artificial sequence
  ptger2_ex2-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 104 - protein, 936 aa, artificial sequence
  ptger2_ex2-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 105 - protein, 936 aa, artificial sequence
  ILT2_1-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 106 - protein, 936 aa, artificial sequence
  ILT2_1-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 107 - protein, 936 aa, artificial sequence
  ILT2_2-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 108 - protein, 936 aa, artificial sequence
  ILT2_2-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 109 - protein, 936 aa, artificial sequence
  ILT4_1-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 110 - protein, 936 aa, artificial sequence
  ILT4_1-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 111 - protein, 936 aa, artificial sequence
  ILT4_2-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 112 - protein, 936 aa, artificial sequence
  ILT4_2-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 113 - protein, 913 aa, artificial sequence
  STAT3_1-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 114 - protein, 913 aa, artificial sequence
  STAT3_1-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 115 - protein, 913 aa, artificial sequence
  STAT3_2-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 116 - protein, 913 aa, artificial sequence
  STAT3_2-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 117 - protein, 913 aa, artificial sequence
  Mt1A_ex2_1-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 118 - protein, 913 aa, artificial sequence
  Mt1A_ex2_1-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 119 - protein, 913 aa, artificial sequence
  Mt1A_ex2_2-L1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 120 - protein, 913 aa, artificial sequence
  Mt1A_ex2_2-R1
MGDPKKKRKVIDYPYDVPDYAIDIADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

The invention claimed is:

1. An engineered immune cell,
wherein said engineered immune cell has been genetically modified by intracellular expression of a rare-cutting endonuclease selected from a TALEN, RNA-guided endonuclease, ZFN, meganuclease, and megaTAL that cleaves an endogenous polynucleotide sequence encoding a SERCA3 protein to inactivate the expression of the SERCA3 protein encoded by the endogenous polynucleotide sequence and interrupt calcium transport and signaling,
wherein said engineered immune cell further expresses a chimeric antigen receptor (CAR), and
wherein the inactivation of the expression of the protein results in increased proliferation of the engineered immune cell at low glucose level.

2. The engineered immune cell according to claim 1, wherein said endogenous polynucleotide coding sequence is inactivated by the insertion of exogenous polynucleotide sequences expressing the CAR.

3. The engineered immune cell according to claim 1, wherein said engineered immune cell is further engineered to reduce or inactivate the expression of one endogenous TCR, β2m or HLA component.

4. The engineered immune cell according to claim 1, wherein said engineered immune cell is a primary immune cell originating from a patient, a donor, or differentiated from stem cells.

5. A population of engineered immune cells, comprising at least 80% of the engineered immune cells according to claim 1.

6. The population of engineered immune cells according to claim 5, wherein at least 80% of the engineered immune cells originate from a donor or stem cell lineage.

7. The population of engineered immune cells according to claim 5, wherein at least 50% of said engineered immune cells are CAR positive cells.

8. A pharmaceutical composition comprising an engineered immune cell according to claim 1.

9. An engineered immune cell or population of engineered immune cells obtained by a method comprising:

providing a population of primary immune cells;
introducing subsequently or simultaneously, into a proportion of said primary immune cells:
at least one nucleic acid comprising an exogenous polynucleotide sequence to express a chimeric antigen receptor; and
at least one sequence-specific reagent selected from a TALEN, RNA-guided endonuclease, ZFN, meganuclease, and megaTAL that specifically targets an endogenous coding sequence encoding SERCA3 to inactivate the expression of the SERCA3 protein encoded by the endogenous polynucleotide sequence and interrupt calcium transport and signaling; and
selecting engineered immune cells.

* * * * *